United States Patent 8,822,426 (PREVENTION AND TREATMENT OF NOSEMA DISEASE IN BEES) - sequence listing, part 8

SEQ ID NO: 229077 - DNA, 21 bp, Artificial sequence
  SiRNA target sequence
tacttaccccttttccaaggc

SEQ ID NO: 229078 - DNA, 21 bp, Artificial sequence
  SiRNA target sequence
acttaccccttttccaaggct

SEQ ID NO: 229079 - DNA, 21 bp, Artificial sequence
  SiRNA target sequence
cttaccccttttccaaggctt

SEQ ID NO: 229080 - DNA, 21 bp, Artificial sequence
  SiRNA target sequence
ttaccccttttccaaggctta

SEQ ID NO: 229081 - DNA, 21 bp, Artificial sequence
  SiRNA target sequence
taccccttttccaaggcttat

SEQ ID NO: 229082 - DNA, 21 bp, Artificial sequence
  SiRNA target sequence
accccttttccaaggcttatt

SEQ ID NO: 229083 - DNA, 21 bp, Artificial sequence
  SiRNA target sequence
ccccttttccaaggcttatta

SEQ ID NO: 229084 - DNA, 21 bp, Artificial sequence
  SiRNA target sequence
cccttttccaaggcttattaa

SEQ ID NO: 229085 - DNA, 21 bp, Artificial sequence
  SiRNA target sequence
ccttttccaaggcttattaaa

SEQ ID NO: 229086 - DNA, 21 bp, Artificial sequence
  SiRNA target sequence
cttttccaaggcttattaaaa

SEQ ID NO: 229087 - DNA, 21 bp, Artificial sequence
  SiRNA target sequence
ttttccaaggcttattaaaac

SEQ ID NO: 229088 - DNA, 21 bp, Artificial sequence
  SiRNA target sequence
tttccaaggcttattaaaaca

SEQ ID NO: 229089 - DNA, 21 bp, Artificial sequence
  SiRNA target sequence
ttccaaggcttattaaaacaa

SEQ ID NO: 229090 - DNA, 21 bp, Artificial sequence
  SiRNA target sequence
tccaaggcttattaaaacaaa

SEQ ID NO: 229091 - DNA, 21 bp, Artificial sequence
  SiRNA target sequence
ccaaggcttattaaaacaaaa

SEQ ID NO: 229092 - DNA, 21 bp, Artificial sequence
  SiRNA target sequence
caaggcttattaaaacaaaag

SEQ ID NO: 229093 - DNA, 21 bp, Artificial sequence
  SiRNA target sequence
aaggcttattaaaacaaaagg

SEQ ID NO: 229094 - DNA, 21 bp, Artificial sequence
  SiRNA target sequence
aggcttattaaaacaaaagga

SEQ ID NO: 229095 - DNA, 21 bp, Artificial sequence
  SiRNA target sequence
ggcttattaaaacaaaaggat

SEQ ID NO: 229096 - DNA, 21 bp, Artificial sequence
  SiRNA target sequence
gcttattaaaacaaaaggatg

SEQ ID NO: 229097 - DNA, 21 bp, Artificial sequence
  SiRNA target sequence
cttattaaaacaaaaggatgg

SEQ ID NO: 229098 - DNA, 21 bp, Artificial sequence
  SiRNA target sequence
ttattaaaacaaaaggatgga

SEQ ID NO: 229099 - DNA, 21 bp, Artificial sequence
  SiRNA target sequence
tattaaaacaaaaggatggat

SEQ ID NO: 229100 - DNA, 21 bp, Artificial sequence
  SiRNA target sequence
attaaaacaaaaggatggatt

SEQ ID NO: 229101 - DNA, 21 bp, Artificial sequence
  SiRNA target sequence
ttaaaacaaaaggatggatta

SEQ ID NO: 229102 - DNA, 21 bp, Artificial sequence
  SiRNA target sequence
taaaacaaaaggatggattac

SEQ ID NO: 229103 - DNA, 21 bp, Artificial sequence
  SiRNA target sequence
aaaacaaaaggatggattaca

SEQ ID NO: 229104 - DNA, 21 bp, Artificial sequence
  SiRNA target sequence
aaacaaaaggatggattacaa

SEQ ID NO: 229105 - DNA, 21 bp, Artificial sequence
  SiRNA target sequence
aacaaaaggatggattacaat

SEQ ID NO: 229106 - DNA, 21 bp, Artificial sequence
  SiRNA target sequence
acaaaaggatggattacaata

SEQ ID NO: 229107 - DNA, 21 bp, Artificial sequence
  SiRNA target sequence
caaaaggatggattacaatag

SEQ ID NO: 229108 - DNA, 21 bp, Artificial sequence
  SiRNA target sequence
aaaaggatggattacaatagc

SEQ ID NO: 229109 - DNA, 21 bp, Artificial sequence
  SiRNA target sequence
aaaggatggattacaatagcc

SEQ ID NO: 229110 - DNA, 21 bp, Artificial sequence
  SiRNA target sequence
aaggatggattacaatagcca

SEQ ID NO: 229111 - DNA, 21 bp, Artificial sequence
  SiRNA target sequence
aggatggattacaatagccat

SEQ ID NO: 229112 - DNA, 21 bp, Artificial sequence
  SiRNA target sequence
ggatggattacaatagccatt

SEQ ID NO: 229113 - DNA, 21 bp, Artificial sequence
  SiRNA target sequence
gatggattacaatagccattc

SEQ ID NO: 229114 - DNA, 21 bp, Artificial sequence
  SiRNA target sequence
atggattacaatagccattct

SEQ ID NO: 229115 - DNA, 21 bp, Artificial sequence
  SiRNA target sequence
tggattacaatagccattcta

SEQ ID NO: 229116 - DNA, 21 bp, Artificial sequence
  SiRNA target sequence
ggattacaatagccattctat

SEQ ID NO: 229117 - DNA, 21 bp, Artificial sequence
  SiRNA target sequence
gattacaatagccattctatg

SEQ ID NO: 229118 - DNA, 21 bp, Artificial sequence
  SiRNA target sequence
attacaatagccattctatgt

SEQ ID NO: 229119 - DNA, 21 bp, Artificial sequence
  SiRNA target sequence
ttacaatagccattctatgtc

SEQ ID NO: 229120 - DNA, 21 bp, Artificial sequence
  SiRNA target sequence
tacaatagccattctatgtcc

SEQ ID NO: 229121 - DNA, 21 bp, Artificial sequence
  SiRNA target sequence
acaatagccattctatgtcct

SEQ ID NO: 229122 - DNA, 21 bp, Artificial sequence
  SiRNA target sequence
caatagccattctatgtccta

SEQ ID NO: 229123 - DNA, 21 bp, Artificial sequence
  SiRNA target sequence
aatagccattctatgtcctat

SEQ ID NO: 229124 - DNA, 21 bp, Artificial sequence
  SiRNA target sequence
atagccattctatgtcctatt

SEQ ID NO: 229125 - DNA, 21 bp, Artificial sequence
  SiRNA target sequence
tagccattctatgtcctatta

SEQ ID NO: 229126 - DNA, 21 bp, Artificial sequence
  SiRNA target sequence
agccattctatgtcctattat

SEQ ID NO: 229127 - DNA, 21 bp, Artificial sequence
  SiRNA target sequence
gccattctatgtcctattatt

SEQ ID NO: 229128 - DNA, 21 bp, Artificial sequence
  SiRNA target sequence
ccattctatgtcctattatta

SEQ ID NO: 229129 - DNA, 21 bp, Artificial sequence
  SiRNA target sequence
cattctatgtcctattattac

SEQ ID NO: 229130 - DNA, 21 bp, Artificial sequence
  SiRNA target sequence
attctatgtcctattattact

SEQ ID NO: 229131 - DNA, 21 bp, Artificial sequence
  SiRNA target sequence
ttctatgtcctattattactt

SEQ ID NO: 229132 - DNA, 21 bp, Artificial sequence
  SiRNA target sequence
tctatgtcctattattacttt

SEQ ID NO: 229133 - DNA, 21 bp, Artificial sequence
  SiRNA target sequence
ctatgtcctattattactttt

SEQ ID NO: 229134 - DNA, 21 bp, Artificial sequence
  SiRNA target sequence
tatgtcctattattacttttt

SEQ ID NO: 229135 - DNA, 21 bp, Artificial sequence
  SiRNA target sequence
atgtcctattattactttttt

SEQ ID NO: 229136 - DNA, 21 bp, Artificial sequence
  SiRNA target sequence
tgtcctattattacttttttt

SEQ ID NO: 229137 - DNA, 21 bp, Artificial sequence
  SiRNA target sequence
gtcctattattactttttttt

SEQ ID NO: 229138 - DNA, 21 bp, Artificial sequence
  SiRNA target sequence
tcctattattacttttttttc

SEQ ID NO: 229139 - DNA, 21 bp, Artificial sequence
  SiRNA target sequence
cctattattacttttttttct

SEQ ID NO: 229140 - DNA, 21 bp, Artificial sequence
  SiRNA target sequence
ctattattacttttttttctg

SEQ ID NO: 229141 - DNA, 21 bp, Artificial sequence
  SiRNA target sequence
tattattacttttttttctgc

SEQ ID NO: 229142 - DNA, 21 bp, Artificial sequence
  SiRNA target sequence
attattacttttttttctgct

SEQ ID NO: 229143 - DNA, 21 bp, Artificial sequence
  SiRNA target sequence
ttattacttttttttctgctt

SEQ ID NO: 229144 - DNA, 21 bp, Artificial sequence
  SiRNA target sequence
tattacttttttttctgcttt

SEQ ID NO: 229145 - DNA, 21 bp, Artificial sequence
  SiRNA target sequence
attacttttttttctgctttt

SEQ ID NO: 229146 - DNA, 21 bp, Artificial sequence
  SiRNA target sequence
ttacttttttttctgcttttg

SEQ ID NO: 229147 - DNA, 21 bp, Artificial sequence
  SiRNA target sequence
tacttttttttctgcttttgg

SEQ ID NO: 229148 - DNA, 21 bp, Artificial sequence
  SiRNA target sequence
acttttttttctgcttttggt

SEQ ID NO: 229149 - DNA, 21 bp, Artificial sequence
  SiRNA target sequence
cttttttttctgcttttggta

SEQ ID NO: 229150 - DNA, 21 bp, Artificial sequence
  SiRNA target sequence
ttttttttctgcttttggtac

SEQ ID NO: 229151 - DNA, 21 bp, Artificial sequence
  SiRNA target sequence
tttttttctgcttttggtact

SEQ ID NO: 229152 - DNA, 21 bp, Artificial sequence
  SiRNA target sequence
ttttttctgcttttggtactt

SEQ ID NO: 229153 - DNA, 21 bp, Artificial sequence
  SiRNA target sequence
tttttctgcttttggtacttt

SEQ ID NO: 229154 - DNA, 21 bp, Artificial sequence
  SiRNA target sequence
ttttctgcttttggtactttt

SEQ ID NO: 229155 - DNA, 21 bp, Artificial sequence
  SiRNA target sequence
tttctgcttttggtacttttg

SEQ ID NO: 229156 - DNA, 21 bp, Artificial sequence
  SiRNA target sequence
ttctgcttttggtacttttgt

SEQ ID NO: 229157 - DNA, 21 bp, Artificial sequence
  SiRNA target sequence
tctgcttttggtacttttgta

SEQ ID NO: 229158 - DNA, 21 bp, Artificial sequence
  SiRNA target sequence
ctgcttttggtacttttgtat

SEQ ID NO: 229159 - DNA, 21 bp, Artificial sequence
  SiRNA target sequence
tgcttttggtacttttgtatt

SEQ ID NO: 229160 - DNA, 21 bp, Artificial sequence
  SiRNA target sequence
gcttttggtacttttgtatta

SEQ ID NO: 229161 - DNA, 21 bp, Artificial sequence
  SiRNA target sequence
cttttggtacttttgtattag

SEQ ID NO: 229162 - DNA, 21 bp, Artificial sequence
  SiRNA target sequence
ttttggtacttttgtattagc

SEQ ID NO: 229163 - DNA, 21 bp, Artificial sequence
  SiRNA target sequence
tttggtacttttgtattagct

SEQ ID NO: 229164 - DNA, 21 bp, Artificial sequence
  SiRNA target sequence
ttggtacttttgtattagctt

SEQ ID NO: 229165 - DNA, 21 bp, Artificial sequence
  SiRNA target sequence
tggtacttttgtattagctta

SEQ ID NO: 229166 - DNA, 21 bp, Artificial sequence
  SiRNA target sequence
ggtacttttgtattagcttat

SEQ ID NO: 229167 - DNA, 21 bp, Artificial sequence
  SiRNA target sequence
gtacttttgtattagcttatt

SEQ ID NO: 229168 - DNA, 21 bp, Artificial sequence
  SiRNA target sequence
tacttttgtattagcttattt

SEQ ID NO: 229169 - DNA, 21 bp, Artificial sequence
  SiRNA target sequence
acttttgtattagcttattta

SEQ ID NO: 229170 - DNA, 21 bp, Artificial sequence
  SiRNA target sequence
cttttgtattagcttatttaa

SEQ ID NO: 229171 - DNA, 21 bp, Artificial sequence
  SiRNA target sequence
ttttgtattagcttatttaaa

SEQ ID NO: 229172 - DNA, 21 bp, Artificial sequence
  SiRNA target sequence
tttgtattagcttatttaaac

SEQ ID NO: 229173 - DNA, 21 bp, Artificial sequence
  SiRNA target sequence
ttgtattagcttatttaaact

SEQ ID NO: 229174 - DNA, 21 bp, Artificial sequence
  SiRNA target sequence
tgtattagcttatttaaactt

SEQ ID NO: 229175 - DNA, 21 bp, Artificial sequence
  SiRNA target sequence
gtattagcttatttaaacttc

SEQ ID NO: 229176 - DNA, 21 bp, Artificial sequence
  SiRNA target sequence
tattagcttatttaaacttcc

SEQ ID NO: 229177 - DNA, 21 bp, Artificial sequence
  SiRNA target sequence
attagcttatttaaacttccc

SEQ ID NO: 229178 - DNA, 21 bp, Artificial sequence
  SiRNA target sequence
ttagcttatttaaacttccca

SEQ ID NO: 229179 - DNA, 21 bp, Artificial sequence
  SiRNA target sequence
tagcttatttaaacttcccaa

SEQ ID NO: 229180 - DNA, 21 bp, Artificial sequence
  SiRNA target sequence
agcttatttaaacttcccaat

SEQ ID NO: 229181 - DNA, 21 bp, Artificial sequence
  SiRNA target sequence
gcttatttaaacttcccaatt

SEQ ID NO: 229182 - DNA, 21 bp, Artificial sequence
  SiRNA target sequence
cttatttaaacttcccaatta

SEQ ID NO: 229183 - DNA, 21 bp, Artificial sequence
  SiRNA target sequence
ttatttaaacttcccaattac

SEQ ID NO: 229184 - DNA, 21 bp, Artificial sequence
  SiRNA target sequence
tatttaaacttcccaattaca

SEQ ID NO: 229185 - DNA, 21 bp, Artificial sequence
  SiRNA target sequence
atttaaacttcccaattacaa

SEQ ID NO: 229186 - DNA, 21 bp, Artificial sequence
  SiRNA target sequence
tttaaacttcccaattacaaa

SEQ ID NO: 229187 - DNA, 21 bp, Artificial sequence
  SiRNA target sequence
ttaaacttcccaattacaaac

SEQ ID NO: 229188 - DNA, 21 bp, Artificial sequence
  SiRNA target sequence
taaacttcccaattacaaaca

SEQ ID NO: 229189 - DNA, 21 bp, Artificial sequence
  SiRNA target sequence
aaacttcccaattacaaacaa

SEQ ID NO: 229190 - DNA, 21 bp, Artificial sequence
  SiRNA target sequence
aacttcccaattacaaacaaa

SEQ ID NO: 229191 - DNA, 21 bp, Artificial sequence
  SiRNA target sequence
acttcccaattacaaacaaag

SEQ ID NO: 229192 - DNA, 21 bp, Artificial sequence
  SiRNA target sequence
cttcccaattacaaacaaaga

SEQ ID NO: 229193 - DNA, 21 bp, Artificial sequence
  SiRNA target sequence
ttcccaattacaaacaaagag

SEQ ID NO: 229194 - DNA, 21 bp, Artificial sequence
  SiRNA target sequence
tcccaattacaaacaaagagg

SEQ ID NO: 229195 - DNA, 21 bp, Artificial sequence
  SiRNA target sequence
cccaattacaaacaaagagga

SEQ ID NO: 229196 - DNA, 21 bp, Artificial sequence
  SiRNA target sequence
ccaattacaaacaaagaggat

SEQ ID NO: 229197 - DNA, 21 bp, Artificial sequence
  SiRNA target sequence
caattacaaacaaagaggata

SEQ ID NO: 229198 - DNA, 21 bp, Artificial sequence
  SiRNA target sequence
aattacaaacaaagaggataa

SEQ ID NO: 229199 - DNA, 21 bp, Artificial sequence
  SiRNA target sequence
attacaaacaaagaggataat

SEQ ID NO: 229200 - DNA, 21 bp, Artificial sequence
  SiRNA target sequence
ttacaaacaaagaggataata

SEQ ID NO: 229201 - DNA, 21 bp, Artificial sequence
  SiRNA target sequence
tacaaacaaagaggataatat

SEQ ID NO: 229202 - DNA, 21 bp, Artificial sequence
  SiRNA target sequence
acaaacaaagaggataatata

SEQ ID NO: 229203 - DNA, 21 bp, Artificial sequence
  SiRNA target sequence
caaacaaagaggataatatat

SEQ ID NO: 229204 - DNA, 21 bp, Artificial sequence
  SiRNA target sequence
aaacaaagaggataatatatt

SEQ ID NO: 229205 - DNA, 21 bp, Artificial sequence
  SiRNA target sequence
aacaaagaggataatatattt

SEQ ID NO: 229206 - DNA, 21 bp, Artificial sequence
  SiRNA target sequence
acaaagaggataatatatttg

SEQ ID NO: 229207 - DNA, 21 bp, Artificial sequence
  SiRNA target sequence
caaagaggataatatatttga

SEQ ID NO: 229208 - DNA, 21 bp, Artificial sequence
  SiRNA target sequence
aaagaggataatatatttgat

SEQ ID NO: 229209 - DNA, 21 bp, Artificial sequence
  SiRNA target sequence
aagaggataatatatttgata

SEQ ID NO: 229210 - DNA, 21 bp, Artificial sequence
  SiRNA target sequence
agaggataatatatttgatat

SEQ ID NO: 229211 - DNA, 21 bp, Artificial sequence
  SiRNA target sequence
gaggataatatatttgatatt

SEQ ID NO: 229212 - DNA, 21 bp, Artificial sequence
  SiRNA target sequence
aggataatatatttgatattt

SEQ ID NO: 229213 - DNA, 21 bp, Artificial sequence
  SiRNA target sequence
ggataatatatttgatattta

SEQ ID NO: 229214 - DNA, 21 bp, Artificial sequence
  SiRNA target sequence
gataatatatttgatatttac

SEQ ID NO: 229215 - DNA, 21 bp, Artificial sequence
  SiRNA target sequence
ataatatatttgatatttacc

SEQ ID NO: 229216 - DNA, 21 bp, Artificial sequence
  SiRNA target sequence
taatatatttgatatttaccg

SEQ ID NO: 229217 - DNA, 21 bp, Artificial sequence
  SiRNA target sequence
aatatatttgatatttaccgt

SEQ ID NO: 229218 - DNA, 21 bp, Artificial sequence
  SiRNA target sequence
atatatttgatatttaccgtt

SEQ ID NO: 229219 - DNA, 21 bp, Artificial sequence
  SiRNA target sequence
tatatttgatatttaccgttt

SEQ ID NO: 229220 - DNA, 21 bp, Artificial sequence
  SiRNA target sequence
atatttgatatttaccgttta

SEQ ID NO: 229221 - DNA, 21 bp, Artificial sequence
  SiRNA target sequence
tatttgatatttaccgtttac

SEQ ID NO: 229222 - DNA, 21 bp, Artificial sequence
  SiRNA target sequence
atttgatatttaccgtttacc

SEQ ID NO: 229223 - DNA, 21 bp, Artificial sequence
  SiRNA target sequence
tttgatatttaccgtttaccg

SEQ ID NO: 229224 - DNA, 21 bp, Artificial sequence
  SiRNA target sequence
ttgatatttaccgtttaccgt

SEQ ID NO: 229225 - DNA, 21 bp, Artificial sequence
  SiRNA target sequence
tgatatttaccgtttaccgtc

SEQ ID NO: 229226 - DNA, 21 bp, Artificial sequence
  SiRNA target sequence
gatatttaccgtttaccgtca

SEQ ID NO: 229227 - DNA, 21 bp, Artificial sequence
  SiRNA target sequence
atatttaccgtttaccgtcaa

SEQ ID NO: 229228 - DNA, 21 bp, Artificial sequence
  SiRNA target sequence
tatttaccgtttaccgtcaac

SEQ ID NO: 229229 - DNA, 21 bp, Artificial sequence
  SiRNA target sequence
atttaccgtttaccgtcaact

SEQ ID NO: 229230 - DNA, 21 bp, Artificial sequence
  SiRNA target sequence
tttaccgtttaccgtcaactg

SEQ ID NO: 229231 - DNA, 21 bp, Artificial sequence
  SiRNA target sequence
ttaccgtttaccgtcaactga

SEQ ID NO: 229232 - DNA, 21 bp, Artificial sequence
  SiRNA target sequence
taccgtttaccgtcaactgat

SEQ ID NO: 229233 - DNA, 21 bp, Artificial sequence
  SiRNA target sequence
accgtttaccgtcaactgatt

SEQ ID NO: 229234 - DNA, 21 bp, Artificial sequence
  SiRNA target sequence
ccgtttaccgtcaactgattc

SEQ ID NO: 229235 - DNA, 21 bp, Artificial sequence
  SiRNA target sequence
cgtttaccgtcaactgattct

SEQ ID NO: 229236 - DNA, 21 bp, Artificial sequence
  SiRNA target sequence
gtttaccgtcaactgattcta

SEQ ID NO: 229237 - DNA, 21 bp, Artificial sequence
  SiRNA target sequence
tttaccgtcaactgattctat

SEQ ID NO: 229238 - DNA, 21 bp, Artificial sequence
  SiRNA target sequence
ttaccgtcaactgattctata

SEQ ID NO: 229239 - DNA, 21 bp, Artificial sequence
  SiRNA target sequence
taccgtcaactgattctataa

SEQ ID NO: 229240 - DNA, 21 bp, Artificial sequence
  SiRNA target sequence
accgtcaactgattctataat

SEQ ID NO: 229241 - DNA, 21 bp, Artificial sequence
  SiRNA target sequence
ccgtcaactgattctataatc

SEQ ID NO: 229242 - DNA, 21 bp, Artificial sequence
  SiRNA target sequence
cgtcaactgattctataatca

SEQ ID NO: 229243 - DNA, 21 bp, Artificial sequence
  SiRNA target sequence
gtcaactgattctataatcaa

SEQ ID NO: 229244 - DNA, 21 bp, Artificial sequence
  SiRNA target sequence
tcaactgattctataatcaaa

SEQ ID NO: 229245 - DNA, 21 bp, Artificial sequence
  SiRNA target sequence
caactgattctataatcaaat

SEQ ID NO: 229246 - DNA, 21 bp, Artificial sequence
  SiRNA target sequence
aactgattctataatcaaatt

SEQ ID NO: 229247 - DNA, 21 bp, Artificial sequence
  SiRNA target sequence
actgattctataatcaaatta

SEQ ID NO: 229248 - DNA, 21 bp, Artificial sequence
  SiRNA target sequence
ctgattctataatcaaattag

SEQ ID NO: 229249 - DNA, 21 bp, Artificial sequence
  SiRNA target sequence
tgattctataatcaaattaga

SEQ ID NO: 229250 - DNA, 21 bp, Artificial sequence
  SiRNA target sequence
gattctataatcaaattagaa

SEQ ID NO: 229251 - DNA, 21 bp, Artificial sequence
  SiRNA target sequence
attctataatcaaattagaaa

SEQ ID NO: 229252 - DNA, 21 bp, Artificial sequence
  SiRNA target sequence
ttctataatcaaattagaaaa

SEQ ID NO: 229253 - DNA, 21 bp, Artificial sequence
  SiRNA target sequence
tctataatcaaattagaaaat

SEQ ID NO: 229254 - DNA, 21 bp, Artificial sequence
  SiRNA target sequence
ctataatcaaattagaaaata

SEQ ID NO: 229255 - DNA, 21 bp, Artificial sequence
  SiRNA target sequence
tataatcaaattagaaaatat

SEQ ID NO: 229256 - DNA, 21 bp, Artificial sequence
  SiRNA target sequence
ataatcaaattagaaaatatt

SEQ ID NO: 229257 - DNA, 21 bp, Artificial sequence
  SiRNA target sequence
taatcaaattagaaaatattg

SEQ ID NO: 229258 - DNA, 21 bp, Artificial sequence
  SiRNA target sequence
aatcaaattagaaaatattgt

SEQ ID NO: 229259 - DNA, 21 bp, Artificial sequence
  SiRNA target sequence
atcaaattagaaaatattgtt

SEQ ID NO: 229260 - DNA, 21 bp, Artificial sequence
  SiRNA target sequence
tcaaattagaaaatattgttg

SEQ ID NO: 229261 - DNA, 21 bp, Artificial sequence
  SiRNA target sequence
caaattagaaaatattgttgg

SEQ ID NO: 229262 - DNA, 21 bp, Artificial sequence
  SiRNA target sequence
aaattagaaaatattgttggt

SEQ ID NO: 229263 - DNA, 21 bp, Artificial sequence
  SiRNA target sequence
aattagaaaatattgttggtg

SEQ ID NO: 229264 - DNA, 21 bp, Artificial sequence
  SiRNA target sequence
attagaaaatattgttggtgt

SEQ ID NO: 229265 - DNA, 21 bp, Artificial sequence
  SiRNA target sequence
ttagaaaatattgttggtgtc

SEQ ID NO: 229266 - DNA, 21 bp, Artificial sequence
  SiRNA target sequence
tagaaaatattgttggtgtca

SEQ ID NO: 229267 - DNA, 21 bp, Artificial sequence
  SiRNA target sequence
agaaaatattgttggtgtcat

SEQ ID NO: 229268 - DNA, 21 bp, Artificial sequence
  SiRNA target sequence
gaaaatattgttggtgtcatt

SEQ ID NO: 229269 - DNA, 21 bp, Artificial sequence
  SiRNA target sequence
aaaatattgttggtgtcattt

SEQ ID NO: 229270 - DNA, 21 bp, Artificial sequence
  SiRNA target sequence
aaatattgttggtgtcatttg

SEQ ID NO: 229271 - DNA, 21 bp, Artificial sequence
  SiRNA target sequence
aatattgttggtgtcatttgt

SEQ ID NO: 229272 - DNA, 21 bp, Artificial sequence
  SiRNA target sequence
atattgttggtgtcatttgtg

SEQ ID NO: 229273 - DNA, 21 bp, Artificial sequence
  SiRNA target sequence
tattgttggtgtcatttgtgt

SEQ ID NO: 229274 - DNA, 21 bp, Artificial sequence
  SiRNA target sequence
attgttggtgtcatttgtgta

SEQ ID NO: 229275 - DNA, 21 bp, Artificial sequence
  SiRNA target sequence
ttgttggtgtcatttgtgtat

SEQ ID NO: 229276 - DNA, 21 bp, Artificial sequence
  SiRNA target sequence
tgttggtgtcatttgtgtatc

SEQ ID NO: 229277 - DNA, 21 bp, Artificial sequence
  SiRNA target sequence
gttggtgtcatttgtgtatct

SEQ ID NO: 229278 - DNA, 21 bp, Artificial sequence
  SiRNA target sequence
ttggtgtcatttgtgtatctt

SEQ ID NO: 229279 - DNA, 21 bp, Artificial sequence
  SiRNA target sequence
tggtgtcatttgtgtatcttt

SEQ ID NO: 229280 - DNA, 21 bp, Artificial sequence
  SiRNA target sequence
ggtgtcatttgtgtatcttta

SEQ ID NO: 229281 - DNA, 21 bp, Artificial sequence
  SiRNA target sequence
gtgtcatttgtgtatctttaa

SEQ ID NO: 229282 - DNA, 21 bp, Artificial sequence
  SiRNA target sequence
tgtcatttgtgtatctttaat

SEQ ID NO: 229283 - DNA, 21 bp, Artificial sequence
  SiRNA target sequence
gtcatttgtgtatctttaatg

SEQ ID NO: 229284 - DNA, 21 bp, Artificial sequence
  SiRNA target sequence
tcatttgtgtatctttaatga

SEQ ID NO: 229285 - DNA, 21 bp, Artificial sequence
  SiRNA target sequence
catttgtgtatctttaatgaa

SEQ ID NO: 229286 - DNA, 21 bp, Artificial sequence
  SiRNA target sequence
atttgtgtatctttaatgaag

SEQ ID NO: 229287 - DNA, 21 bp, Artificial sequence
  SiRNA target sequence
tttgtgtatctttaatgaaga

SEQ ID NO: 229288 - DNA, 21 bp, Artificial sequence
  SiRNA target sequence
ttgtgtatctttaatgaagat

SEQ ID NO: 229289 - DNA, 21 bp, Artificial sequence
  SiRNA target sequence
tgtgtatctttaatgaagatt

SEQ ID NO: 229290 - DNA, 21 bp, Artificial sequence
  SiRNA target sequence
gtgtatctttaatgaagattt

SEQ ID NO: 229291 - DNA, 21 bp, Artificial sequence
  SiRNA target sequence
tgtatctttaatgaagatttc

SEQ ID NO: 229292 - DNA, 21 bp, Artificial sequence
  SiRNA target sequence
gtatctttaatgaagatttct

SEQ ID NO: 229293 - DNA, 21 bp, Artificial sequence
  SiRNA target sequence
tatctttaatgaagatttcta

SEQ ID NO: 229294 - DNA, 21 bp, Artificial sequence
  SiRNA target sequence
atctttaatgaagatttctaa

SEQ ID NO: 229295 - DNA, 21 bp, Artificial sequence
  SiRNA target sequence
tctttaatgaagatttctaaa

SEQ ID NO: 229296 - DNA, 21 bp, Artificial sequence
  SiRNA target sequence
ctttaatgaagatttctaaat

SEQ ID NO: 229297 - DNA, 21 bp, Artificial sequence
  SiRNA target sequence
tttaatgaagatttctaaata

SEQ ID NO: 229298 - DNA, 21 bp, Artificial sequence
  SiRNA target sequence
ttaatgaagatttctaaatat

SEQ ID NO: 229299 - DNA, 21 bp, Artificial sequence
  SiRNA target sequence
taatgaagatttctaaatatg

SEQ ID NO: 229300 - DNA, 21 bp, Artificial sequence
  SiRNA target sequence
aatgaagatttctaaatatgc

SEQ ID NO: 229301 - DNA, 21 bp, Artificial sequence
  SiRNA target sequence
atgaagatttctaaatatgca

SEQ ID NO: 229302 - DNA, 21 bp, Artificial sequence
  SiRNA target sequence
tgaagatttctaaatatgcag

SEQ ID NO: 229303 - DNA, 21 bp, Artificial sequence
  SiRNA target sequence
gaagatttctaaatatgcagc

SEQ ID NO: 229304 - DNA, 21 bp, Artificial sequence
  SiRNA target sequence
aagatttctaaatatgcagca

SEQ ID NO: 229305 - DNA, 21 bp, Artificial sequence
  SiRNA target sequence
agatttctaaatatgcagcat

SEQ ID NO: 229306 - DNA, 21 bp, Artificial sequence
  SiRNA target sequence
gatttctaaatatgcagcatt

SEQ ID NO: 229307 - DNA, 21 bp, Artificial sequence
  SiRNA target sequence
atttctaaatatgcagcattt

SEQ ID NO: 229308 - DNA, 21 bp, Artificial sequence
  SiRNA target sequence
tttctaaatatgcagcatttg

SEQ ID NO: 229309 - DNA, 21 bp, Artificial sequence
  SiRNA target sequence
ttctaaatatgcagcatttga

SEQ ID NO: 229310 - DNA, 21 bp, Artificial sequence
  SiRNA target sequence
tctaaatatgcagcatttgat

SEQ ID NO: 229311 - DNA, 21 bp, Artificial sequence
  SiRNA target sequence
ctaaatatgcagcatttgata

SEQ ID NO: 229312 - DNA, 21 bp, Artificial sequence
  SiRNA target sequence
taaatatgcagcatttgatat

SEQ ID NO: 229313 - DNA, 21 bp, Artificial sequence
  SiRNA target sequence
aaatatgcagcatttgatatc

SEQ ID NO: 229314 - DNA, 21 bp, Artificial sequence
  SiRNA target sequence
aatatgcagcatttgatatca

SEQ ID NO: 229315 - DNA, 21 bp, Artificial sequence
  SiRNA target sequence
atatgcagcatttgatatcac

SEQ ID NO: 229316 - DNA, 21 bp, Artificial sequence
  SiRNA target sequence
tatgcagcatttgatatcaca

SEQ ID NO: 229317 - DNA, 21 bp, Artificial sequence
  SiRNA target sequence
atgcagcatttgatatcacaa

SEQ ID NO: 229318 - DNA, 21 bp, Artificial sequence
  SiRNA target sequence
tgcagcatttgatatcacaaa

SEQ ID NO: 229319 - DNA, 21 bp, Artificial sequence
  SiRNA target sequence
gcagcatttgatatcacaaaa

SEQ ID NO: 229320 - DNA, 21 bp, Artificial sequence
  SiRNA target sequence
cagcatttgatatcacaaaag

SEQ ID NO: 229321 - DNA, 21 bp, Artificial sequence
  SiRNA target sequence
agcatttgatatcacaaaaga

SEQ ID NO: 229322 - DNA, 21 bp, Artificial sequence
  SiRNA target sequence
gcatttgatatcacaaaagag

SEQ ID NO: 229323 - DNA, 21 bp, Artificial sequence
  SiRNA target sequence
catttgatatcacaaaagagg

SEQ ID NO: 229324 - DNA, 21 bp, Artificial sequence
  SiRNA target sequence
atttgatatcacaaaagaggc

SEQ ID NO: 229325 - DNA, 21 bp, Artificial sequence
  SiRNA target sequence
tttgatatcacaaaagaggct

SEQ ID NO: 229326 - DNA, 21 bp, Artificial sequence
  SiRNA target sequence
ttgatatcacaaaagaggctt

SEQ ID NO: 229327 - DNA, 21 bp, Artificial sequence
  SiRNA target sequence
tgatatcacaaaagaggcttt

SEQ ID NO: 229328 - DNA, 21 bp, Artificial sequence
  SiRNA target sequence
gatatcacaaaagaggctttg

SEQ ID NO: 229329 - DNA, 21 bp, Artificial sequence
  SiRNA target sequence
atatcacaaaagaggctttgt

SEQ ID NO: 229330 - DNA, 21 bp, Artificial sequence
  SiRNA target sequence
tatcacaaaagaggctttgtc

SEQ ID NO: 229331 - DNA, 21 bp, Artificial sequence
  SiRNA target sequence
atcacaaaagaggctttgtct

SEQ ID NO: 229332 - DNA, 21 bp, Artificial sequence
  SiRNA target sequence
tcacaaaagaggctttgtcta

SEQ ID NO: 229333 - DNA, 21 bp, Artificial sequence
  SiRNA target sequence
cacaaaagaggctttgtctat

SEQ ID NO: 229334 - DNA, 21 bp, Artificial sequence
  SiRNA target sequence
acaaaagaggctttgtctatg

SEQ ID NO: 229335 - DNA, 21 bp, Artificial sequence
  SiRNA target sequence
caaaagaggctttgtctatgc

SEQ ID NO: 229336 - DNA, 21 bp, Artificial sequence
  SiRNA target sequence
aaaagaggctttgtctatgca

SEQ ID NO: 229337 - DNA, 21 bp, Artificial sequence
  SiRNA target sequence
aaagaggctttgtctatgcag

SEQ ID NO: 229338 - DNA, 21 bp, Artificial sequence
  SiRNA target sequence
aagaggctttgtctatgcaga

SEQ ID NO: 229339 - DNA, 21 bp, Artificial sequence
  SiRNA target sequence
agaggctttgtctatgcagat

SEQ ID NO: 229340 - DNA, 21 bp, Artificial sequence
  SiRNA target sequence
gaggctttgtctatgcagatt

SEQ ID NO: 229341 - DNA, 21 bp, Artificial sequence
  SiRNA target sequence
aggctttgtctatgcagattg

SEQ ID NO: 229342 - DNA, 21 bp, Artificial sequence
  SiRNA target sequence
ggctttgtctatgcagattga

SEQ ID NO: 229343 - DNA, 21 bp, Artificial sequence
  SiRNA target sequence
gctttgtctatgcagattgat

SEQ ID NO: 229344 - DNA, 21 bp, Artificial sequence
  SiRNA target sequence
ctttgtctatgcagattgatg

SEQ ID NO: 229345 - DNA, 21 bp, Artificial sequence
  SiRNA target sequence
tttgtctatgcagattgatgg

SEQ ID NO: 229346 - DNA, 21 bp, Artificial sequence
  SiRNA target sequence
ttgtctatgcagattgatggt

SEQ ID NO: 229347 - DNA, 21 bp, Artificial sequence
  SiRNA target sequence
tgtctatgcagattgatggtt

SEQ ID NO: 229348 - DNA, 21 bp, Artificial sequence
  SiRNA target sequence
gtctatgcagattgatggttc

SEQ ID NO: 229349 - DNA, 21 bp, Artificial sequence
  SiRNA target sequence
tctatgcagattgatggttct

SEQ ID NO: 229350 - DNA, 21 bp, Artificial sequence
  SiRNA target sequence
ctatgcagattgatggttcta

SEQ ID NO: 229351 - DNA, 21 bp, Artificial sequence
  SiRNA target sequence
tatgcagattgatggttctat

SEQ ID NO: 229352 - DNA, 21 bp, Artificial sequence
  SiRNA target sequence
atgcagattgatggttctata

SEQ ID NO: 229353 - DNA, 21 bp, Artificial sequence
  SiRNA target sequence
tgcagattgatggttctataa

SEQ ID NO: 229354 - DNA, 21 bp, Artificial sequence
  SiRNA target sequence
gcagattgatggttctataag

SEQ ID NO: 229355 - DNA, 21 bp, Artificial sequence
  SiRNA target sequence
cagattgatggttctataaga

SEQ ID NO: 229356 - DNA, 21 bp, Artificial sequence
  SiRNA target sequence
agattgatggttctataagag

SEQ ID NO: 229357 - DNA, 21 bp, Artificial sequence
  SiRNA target sequence
gattgatggttctataagagc

SEQ ID NO: 229358 - DNA, 21 bp, Artificial sequence
  SiRNA target sequence
attgatggttctataagagcg

SEQ ID NO: 229359 - DNA, 21 bp, Artificial sequence
  SiRNA target sequence
ttgatggttctataagagcga

SEQ ID NO: 229360 - DNA, 21 bp, Artificial sequence
  SiRNA target sequence
tgatggttctataagagcgaa

SEQ ID NO: 229361 - DNA, 21 bp, Artificial sequence
  SiRNA target sequence
gatggttctataagagcgaaa

SEQ ID NO: 229362 - DNA, 21 bp, Artificial sequence
  SiRNA target sequence
atggttctataagagcgaaat

SEQ ID NO: 229363 - DNA, 21 bp, Artificial sequence
  SiRNA target sequence
tggttctataagagcgaaata

SEQ ID NO: 229364 - DNA, 21 bp, Artificial sequence
  SiRNA target sequence
ggttctataagagcgaaatac

SEQ ID NO: 229365 - DNA, 21 bp, Artificial sequence
  SiRNA target sequence
gttctataagagcgaaataca

SEQ ID NO: 229366 - DNA, 21 bp, Artificial sequence
  SiRNA target sequence
ttctataagagcgaaatacaa

SEQ ID NO: 229367 - DNA, 21 bp, Artificial sequence
  SiRNA target sequence
tctataagagcgaaatacaaa

SEQ ID NO: 229368 - DNA, 21 bp, Artificial sequence
  SiRNA target sequence
ctataagagcgaaatacaaag

SEQ ID NO: 229369 - DNA, 21 bp, Artificial sequence
  SiRNA target sequence
tataagagcgaaatacaaagg

SEQ ID NO: 229370 - DNA, 21 bp, Artificial sequence
  SiRNA target sequence
ataagagcgaaatacaaaggt

SEQ ID NO: 229371 - DNA, 21 bp, Artificial sequence
  SiRNA target sequence
taagagcgaaatacaaaggta

SEQ ID NO: 229372 - DNA, 21 bp, Artificial sequence
  SiRNA target sequence
aagagcgaaatacaaaggtat

SEQ ID NO: 229373 - DNA, 21 bp, Artificial sequence
  SiRNA target sequence
agagcgaaatacaaaggtatt

SEQ ID NO: 229374 - DNA, 21 bp, Artificial sequence
  SiRNA target sequence
gagcgaaatacaaaggtattt

SEQ ID NO: 229375 - DNA, 21 bp, Artificial sequence
  SiRNA target sequence
agcgaaatacaaaggtatttt

SEQ ID NO: 229376 - DNA, 21 bp, Artificial sequence
  SiRNA target sequence
gcgaaatacaaaggtattttt

SEQ ID NO: 229377 - DNA, 21 bp, Artificial sequence
  SiRNA target sequence
cgaaatacaaaggtatttttg

SEQ ID NO: 229378 - DNA, 21 bp, Artificial sequence
  SiRNA target sequence
gaaatacaaaggtatttttga

SEQ ID NO: 229379 - DNA, 21 bp, Artificial sequence
  SiRNA target sequence
aaatacaaaggtatttttgat

SEQ ID NO: 229380 - DNA, 21 bp, Artificial sequence
  SiRNA target sequence
aatacaaaggtatttttgatg

SEQ ID NO: 229381 - DNA, 21 bp, Artificial sequence
  SiRNA target sequence
atacaaaggtatttttgatgg

SEQ ID NO: 229382 - DNA, 21 bp, Artificial sequence
  SiRNA target sequence
tacaaaggtatttttgatggt

SEQ ID NO: 229383 - DNA, 21 bp, Artificial sequence
  SiRNA target sequence
acaaaggtatttttgatggtg

SEQ ID NO: 229384 - DNA, 21 bp, Artificial sequence
  SiRNA target sequence
caaaggtatttttgatggtgt

SEQ ID NO: 229385 - DNA, 21 bp, Artificial sequence
  SiRNA target sequence
aaaggtatttttgatggtgta

SEQ ID NO: 229386 - DNA, 21 bp, Artificial sequence
  SiRNA target sequence
aaggtatttttgatggtgtat

SEQ ID NO: 229387 - DNA, 21 bp, Artificial sequence
  SiRNA target sequence
aggtatttttgatggtgtatt

SEQ ID NO: 229388 - DNA, 21 bp, Artificial sequence
  SiRNA target sequence
ggtatttttgatggtgtattt

SEQ ID NO: 229389 - DNA, 21 bp, Artificial sequence
  SiRNA target sequence
gtatttttgatggtgtatttg

SEQ ID NO: 229390 - DNA, 21 bp, Artificial sequence
  SiRNA target sequence
tatttttgatggtgtatttgg

SEQ ID NO: 229391 - DNA, 21 bp, Artificial sequence
  SiRNA target sequence
atttttgatggtgtatttggt

SEQ ID NO: 229392 - DNA, 21 bp, Artificial sequence
  SiRNA target sequence
tttttgatggtgtatttggta

SEQ ID NO: 229393 - DNA, 21 bp, Artificial sequence
  SiRNA target sequence
ttttgatggtgtatttggtaa

SEQ ID NO: 229394 - DNA, 21 bp, Artificial sequence
  SiRNA target sequence
tttgatggtgtatttggtaag

SEQ ID NO: 229395 - DNA, 21 bp, Artificial sequence
  SiRNA target sequence
ttgatggtgtatttggtaagc

SEQ ID NO: 229396 - DNA, 21 bp, Artificial sequence
  SiRNA target sequence
tgatggtgtatttggtaagct

SEQ ID NO: 229397 - DNA, 21 bp, Artificial sequence
  SiRNA target sequence
gatggtgtatttggtaagctg

SEQ ID NO: 229398 - DNA, 21 bp, Artificial sequence
  SiRNA target sequence
atggtgtatttggtaagctgg

SEQ ID NO: 229399 - DNA, 21 bp, Artificial sequence
  SiRNA target sequence
tggtgtatttggtaagctggg

SEQ ID NO: 229400 - DNA, 21 bp, Artificial sequence
  SiRNA target sequence
ggtgtatttggtaagctgggg

SEQ ID NO: 229401 - DNA, 21 bp, Artificial sequence
  SiRNA target sequence
gtgtatttggtaagctgggga

SEQ ID NO: 229402 - DNA, 21 bp, Artificial sequence
  SiRNA target sequence
tgtatttggtaagctggggaa

SEQ ID NO: 229403 - DNA, 21 bp, Artificial sequence
  SiRNA target sequence
gtatttggtaagctggggaaa

SEQ ID NO: 229404 - DNA, 21 bp, Artificial sequence
  SiRNA target sequence
tatttggtaagctggggaaat

SEQ ID NO: 229405 - DNA, 21 bp, Artificial sequence
  SiRNA target sequence
atttggtaagctggggaaatc

SEQ ID NO: 229406 - DNA, 21 bp, Artificial sequence
  SiRNA target sequence
tttggtaagctggggaaatct

SEQ ID NO: 229407 - DNA, 21 bp, Artificial sequence
  SiRNA target sequence
ttggtaagctggggaaatctt

SEQ ID NO: 229408 - DNA, 21 bp, Artificial sequence
  SiRNA target sequence
tggtaagctggggaaatcttt

SEQ ID NO: 229409 - DNA, 21 bp, Artificial sequence
  SiRNA target sequence
ggtaagctggggaaatctttt

SEQ ID NO: 229410 - DNA, 21 bp, Artificial sequence
  SiRNA target sequence
gtaagctggggaaatcttttg

SEQ ID NO: 229411 - DNA, 21 bp, Artificial sequence
  SiRNA target sequence
taagctggggaaatcttttgg

SEQ ID NO: 229412 - DNA, 21 bp, Artificial sequence
  SiRNA target sequence
aagctggggaaatcttttgga

SEQ ID NO: 229413 - DNA, 21 bp, Artificial sequence
  SiRNA target sequence
agctggggaaatcttttggat

SEQ ID NO: 229414 - DNA, 21 bp, Artificial sequence
  SiRNA target sequence
gctggggaaatcttttggatc

SEQ ID NO: 229415 - DNA, 21 bp, Artificial sequence
  SiRNA target sequence
ctggggaaatcttttggatca

SEQ ID NO: 229416 - DNA, 21 bp, Artificial sequence
  SiRNA target sequence
tggggaaatcttttggatcag

SEQ ID NO: 229417 - DNA, 21 bp, Artificial sequence
  SiRNA target sequence
ggggaaatcttttggatcagt

SEQ ID NO: 229418 - DNA, 21 bp, Artificial sequence
  SiRNA target sequence
gggaaatcttttggatcagtt

SEQ ID NO: 229419 - DNA, 21 bp, Artificial sequence
  SiRNA target sequence
ggaaatcttttggatcagttt

SEQ ID NO: 229420 - DNA, 21 bp, Artificial sequence
  SiRNA target sequence
gaaatcttttggatcagttta

SEQ ID NO: 229421 - DNA, 21 bp, Artificial sequence
  SiRNA target sequence
aaatcttttggatcagtttat

SEQ ID NO: 229422 - DNA, 21 bp, Artificial sequence
  SiRNA target sequence
aatcttttggatcagtttatg

SEQ ID NO: 229423 - DNA, 21 bp, Artificial sequence
  SiRNA target sequence
atcttttggatcagtttatgg

SEQ ID NO: 229424 - DNA, 21 bp, Artificial sequence
  SiRNA target sequence
tcttttggatcagtttatgga

SEQ ID NO: 229425 - DNA, 21 bp, Artificial sequence
  SiRNA target sequence
cttttggatcagtttatggat

SEQ ID NO: 229426 - DNA, 21 bp, Artificial sequence
  SiRNA target sequence
ttttggatcagtttatggatt

SEQ ID NO: 229427 - DNA, 21 bp, Artificial sequence
  SiRNA target sequence
tttggatcagtttatggattt

SEQ ID NO: 229428 - DNA, 21 bp, Artificial sequence
  SiRNA target sequence
ttggatcagtttatggattta

SEQ ID NO: 229429 - DNA, 21 bp, Artificial sequence
  SiRNA target sequence
tggatcagtttatggatttac

SEQ ID NO: 229430 - DNA, 21 bp, Artificial sequence
  SiRNA target sequence
ggatcagtttatggatttaca

SEQ ID NO: 229431 - DNA, 21 bp, Artificial sequence
  SiRNA target sequence
gatcagtttatggatttacaa

SEQ ID NO: 229432 - DNA, 21 bp, Artificial sequence
  SiRNA target sequence
atcagtttatggatttacaat

SEQ ID NO: 229433 - DNA, 21 bp, Artificial sequence
  SiRNA target sequence
tcagtttatggatttacaatt

SEQ ID NO: 229434 - DNA, 21 bp, Artificial sequence
  SiRNA target sequence
cagtttatggatttacaatta

SEQ ID NO: 229435 - DNA, 21 bp, Artificial sequence
  SiRNA target sequence
agtttatggatttacaattac

SEQ ID NO: 229436 - DNA, 21 bp, Artificial sequence
  SiRNA target sequence
gtttatggatttacaattact

SEQ ID NO: 229437 - DNA, 21 bp, Artificial sequence
  SiRNA target sequence
tttatggatttacaattacta

SEQ ID NO: 229438 - DNA, 21 bp, Artificial sequence
  SiRNA target sequence
ttatggatttacaattactac

SEQ ID NO: 229439 - DNA, 21 bp, Artificial sequence
  SiRNA target sequence
tatggatttacaattactaca

SEQ ID NO: 229440 - DNA, 21 bp, Artificial sequence
  SiRNA target sequence
atggatttacaattactacat

SEQ ID NO: 229441 - DNA, 21 bp, Artificial sequence
  SiRNA target sequence
tggatttacaattactacatt

SEQ ID NO: 229442 - DNA, 21 bp, Artificial sequence
  SiRNA target sequence
ggatttacaattactacatta

SEQ ID NO: 229443 - DNA, 21 bp, Artificial sequence
  SiRNA target sequence
gatttacaattactacattat

SEQ ID NO: 229444 - DNA, 21 bp, Artificial sequence
  SiRNA target sequence
atttacaattactacattatt

SEQ ID NO: 229445 - DNA, 21 bp, Artificial sequence
  SiRNA target sequence
tttacaattactacattatta

SEQ ID NO: 229446 - DNA, 21 bp, Artificial sequence
  SiRNA target sequence
ttacaattactacattattag

SEQ ID NO: 229447 - DNA, 21 bp, Artificial sequence
  SiRNA target sequence
tacaattactacattattagg

SEQ ID NO: 229448 - DNA, 21 bp, Artificial sequence
  SiRNA target sequence
acaattactacattattagga

SEQ ID NO: 229449 - DNA, 21 bp, Artificial sequence
  SiRNA target sequence
caattactacattattaggaa

SEQ ID NO: 229450 - DNA, 21 bp, Artificial sequence
  SiRNA target sequence
aattactacattattaggaac

SEQ ID NO: 229451 - DNA, 21 bp, Artificial sequence
  SiRNA target sequence
attactacattattaggaaca

SEQ ID NO: 229452 - DNA, 21 bp, Artificial sequence
  SiRNA target sequence
ttactacattattaggaacaa

SEQ ID NO: 229453 - DNA, 21 bp, Artificial sequence
  SiRNA target sequence
tactacattattaggaacaag

SEQ ID NO: 229454 - DNA, 21 bp, Artificial sequence
  SiRNA target sequence
actacattattaggaacaaga

SEQ ID NO: 229455 - DNA, 21 bp, Artificial sequence
  SiRNA target sequence
ctacattattaggaacaagag

SEQ ID NO: 229456 - DNA, 21 bp, Artificial sequence
  SiRNA target sequence
tacattattaggaacaagaga

SEQ ID NO: 229457 - DNA, 21 bp, Artificial sequence
  SiRNA target sequence
acattattaggaacaagagat

SEQ ID NO: 229458 - DNA, 21 bp, Artificial sequence
  SiRNA target sequence
cattattaggaacaagagatg

SEQ ID NO: 229459 - DNA, 21 bp, Artificial sequence
  SiRNA target sequence
attattaggaacaagagatgt

SEQ ID NO: 229460 - DNA, 21 bp, Artificial sequence
  SiRNA target sequence
ttattaggaacaagagatgtt

SEQ ID NO: 229461 - DNA, 21 bp, Artificial sequence
  SiRNA target sequence
tattaggaacaagagatgttc

SEQ ID NO: 229462 - DNA, 21 bp, Artificial sequence
  SiRNA target sequence
attaggaacaagagatgttcg

SEQ ID NO: 229463 - DNA, 21 bp, Artificial sequence
  SiRNA target sequence
ttaggaacaagagatgttcgt

SEQ ID NO: 229464 - DNA, 21 bp, Artificial sequence
  SiRNA target sequence
taggaacaagagatgttcgta

SEQ ID NO: 229465 - DNA, 21 bp, Artificial sequence
  SiRNA target sequence
aggaacaagagatgttcgtag

SEQ ID NO: 229466 - DNA, 21 bp, Artificial sequence
  SiRNA target sequence
ggaacaagagatgttcgtaga

SEQ ID NO: 229467 - DNA, 21 bp, Artificial sequence
  SiRNA target sequence
gaacaagagatgttcgtagag

SEQ ID NO: 229468 - DNA, 21 bp, Artificial sequence
  SiRNA target sequence
aacaagagatgttcgtagagg

SEQ ID NO: 229469 - DNA, 21 bp, Artificial sequence
  SiRNA target sequence
acaagagatgttcgtagaggt

SEQ ID NO: 229470 - DNA, 21 bp, Artificial sequence
  SiRNA target sequence
caagagatgttcgtagaggtg

SEQ ID NO: 229471 - DNA, 21 bp, Artificial sequence
  SiRNA target sequence
aagagatgttcgtagaggtgc

SEQ ID NO: 229472 - DNA, 21 bp, Artificial sequence
  SiRNA target sequence
agagatgttcgtagaggtgct

SEQ ID NO: 229473 - DNA, 21 bp, Artificial sequence
  SiRNA target sequence
gagatgttcgtagaggtgctc

SEQ ID NO: 229474 - DNA, 21 bp, Artificial sequence
  SiRNA target sequence
agatgttcgtagaggtgctcc

SEQ ID NO: 229475 - DNA, 21 bp, Artificial sequence
  SiRNA target sequence
gatgttcgtagaggtgctcct

SEQ ID NO: 229476 - DNA, 21 bp, Artificial sequence
  SiRNA target sequence
atgttcgtagaggtgctccta

SEQ ID NO: 229477 - DNA, 21 bp, Artificial sequence
  SiRNA target sequence
tgttcgtagaggtgctcctat

SEQ ID NO: 229478 - DNA, 21 bp, Artificial sequence
  SiRNA target sequence
gttcgtagaggtgctcctata

SEQ ID NO: 229479 - DNA, 21 bp, Artificial sequence
  SiRNA target sequence
ttcgtagaggtgctcctatat

SEQ ID NO: 229480 - DNA, 21 bp, Artificial sequence
  SiRNA target sequence
tcgtagaggtgctcctatatc

SEQ ID NO: 229481 - DNA, 21 bp, Artificial sequence
  SiRNA target sequence
cgtagaggtgctcctatatcg

SEQ ID NO: 229482 - DNA, 21 bp, Artificial sequence
  SiRNA target sequence
gtagaggtgctcctatatcgc

SEQ ID NO: 229483 - DNA, 21 bp, Artificial sequence
  SiRNA target sequence
tagaggtgctcctatatcgct

SEQ ID NO: 229484 - DNA, 21 bp, Artificial sequence
  SiRNA target sequence
agaggtgctcctatatcgctt

SEQ ID NO: 229485 - DNA, 21 bp, Artificial sequence
  SiRNA target sequence
gaggtgctcctatatcgcttt

SEQ ID NO: 229486 - DNA, 21 bp, Artificial sequence
  SiRNA target sequence
aggtgctcctatatcgctttg

SEQ ID NO: 229487 - DNA, 21 bp, Artificial sequence
  SiRNA target sequence
ggtgctcctatatcgctttgt

SEQ ID NO: 229488 - DNA, 21 bp, Artificial sequence
  SiRNA target sequence
gtgctcctatatcgctttgtg

SEQ ID NO: 229489 - DNA, 21 bp, Artificial sequence
  SiRNA target sequence
tgctcctatatcgctttgtgt

SEQ ID NO: 229490 - DNA, 21 bp, Artificial sequence
  SiRNA target sequence
gctcctatatcgctttgtgtt

SEQ ID NO: 229491 - DNA, 21 bp, Artificial sequence
  SiRNA target sequence
ctcctatatcgctttgtgttc

SEQ ID NO: 229492 - DNA, 21 bp, Artificial sequence
  SiRNA target sequence
tcctatatcgctttgtgttct

SEQ ID NO: 229493 - DNA, 21 bp, Artificial sequence
  SiRNA target sequence
cctatatcgctttgtgttcta

SEQ ID NO: 229494 - DNA, 21 bp, Artificial sequence
  SiRNA target sequence
ctatatcgctttgtgttctaa

SEQ ID NO: 229495 - DNA, 21 bp, Artificial sequence
  SiRNA target sequence
tatatcgctttgtgttctaat

SEQ ID NO: 229496 - DNA, 21 bp, Artificial sequence
  SiRNA target sequence
atatcgctttgtgttctaata

SEQ ID NO: 229497 - DNA, 21 bp, Artificial sequence
  SiRNA target sequence
tatcgctttgtgttctaatat

SEQ ID NO: 229498 - DNA, 21 bp, Artificial sequence
  SiRNA target sequence
atcgctttgtgttctaatatt

SEQ ID NO: 229499 - DNA, 21 bp, Artificial sequence
  SiRNA target sequence
tcgctttgtgttctaatattg

SEQ ID NO: 229500 - DNA, 21 bp, Artificial sequence
  SiRNA target sequence
cgctttgtgttctaatattgt

SEQ ID NO: 229501 - DNA, 21 bp, Artificial sequence
  SiRNA target sequence
gctttgtgttctaatattgtt

SEQ ID NO: 229502 - DNA, 21 bp, Artificial sequence
  SiRNA target sequence
ctttgtgttctaatattgttc

SEQ ID NO: 229503 - DNA, 21 bp, Artificial sequence
  SiRNA target sequence
tttgtgttctaatattgttct

SEQ ID NO: 229504 - DNA, 21 bp, Artificial sequence
  SiRNA target sequence
ttgtgttctaatattgttctg

SEQ ID NO: 229505 - DNA, 21 bp, Artificial sequence
  SiRNA target sequence
tgtgttctaatattgttctgc

SEQ ID NO: 229506 - DNA, 21 bp, Artificial sequence
  SiRNA target sequence
gtgttctaatattgttctgcc

SEQ ID NO: 229507 - DNA, 21 bp, Artificial sequence
  SiRNA target sequence
tgttctaatattgttctgcct

SEQ ID NO: 229508 - DNA, 21 bp, Artificial sequence
  SiRNA target sequence
gttctaatattgttctgcctt

SEQ ID NO: 229509 - DNA, 21 bp, Artificial sequence
  SiRNA target sequence
ttctaatattgttctgcctta

SEQ ID NO: 229510 - DNA, 21 bp, Artificial sequence
  SiRNA target sequence
tctaatattgttctgccttat

SEQ ID NO: 229511 - DNA, 21 bp, Artificial sequence
  SiRNA target sequence
ctaatattgttctgccttata

SEQ ID NO: 229512 - DNA, 21 bp, Artificial sequence
  SiRNA target sequence
taatattgttctgccttatat

SEQ ID NO: 229513 - DNA, 21 bp, Artificial sequence
  SiRNA target sequence
aatattgttctgccttatatg

SEQ ID NO: 229514 - DNA, 21 bp, Artificial sequence
  SiRNA target sequence
atattgttctgccttatatgg

SEQ ID NO: 229515 - DNA, 21 bp, Artificial sequence
  SiRNA target sequence
tattgttctgccttatatggt

SEQ ID NO: 229516 - DNA, 21 bp, Artificial sequence
  SiRNA target sequence
attgttctgccttatatggtt

SEQ ID NO: 229517 - DNA, 21 bp, Artificial sequence
  SiRNA target sequence
ttgttctgccttatatggttt

SEQ ID NO: 229518 - DNA, 21 bp, Artificial sequence
  SiRNA target sequence
tgttctgccttatatggtttt

SEQ ID NO: 229519 - DNA, 21 bp, Artificial sequence
  SiRNA target sequence
gttctgccttatatggtttta

SEQ ID NO: 229520 - DNA, 21 bp, Artificial sequence
  SiRNA target sequence
ttctgccttatatggttttat

SEQ ID NO: 229521 - DNA, 21 bp, Artificial sequence
  SiRNA target sequence
tctgccttatatggttttatt

SEQ ID NO: 229522 - DNA, 21 bp, Artificial sequence
  SiRNA target sequence
ctgccttatatggttttattc

SEQ ID NO: 229523 - DNA, 21 bp, Artificial sequence
  SiRNA target sequence
tgccttatatggttttattct

SEQ ID NO: 229524 - DNA, 21 bp, Artificial sequence
  SiRNA target sequence
gccttatatggttttattctg

SEQ ID NO: 229525 - DNA, 21 bp, Artificial sequence
  SiRNA target sequence
ccttatatggttttattctgt

SEQ ID NO: 229526 - DNA, 21 bp, Artificial sequence
  SiRNA target sequence
cttatatggttttattctgtt

SEQ ID NO: 229527 - DNA, 21 bp, Artificial sequence
  SiRNA target sequence
ttatatggttttattctgttt

SEQ ID NO: 229528 - DNA, 21 bp, Artificial sequence
  SiRNA target sequence
tatatggttttattctgtttt

SEQ ID NO: 229529 - DNA, 21 bp, Artificial sequence
  SiRNA target sequence
atatggttttattctgttttc

SEQ ID NO: 229530 - DNA, 21 bp, Artificial sequence
  SiRNA target sequence
tatggttttattctgttttct

SEQ ID NO: 229531 - DNA, 21 bp, Artificial sequence
  SiRNA target sequence
atggttttattctgttttcta

SEQ ID NO: 229532 - DNA, 21 bp, Artificial sequence
  SiRNA target sequence
tggttttattctgttttctat

SEQ ID NO: 229533 - DNA, 21 bp, Artificial sequence
  SiRNA target sequence
ggttttattctgttttctatc

SEQ ID NO: 229534 - DNA, 21 bp, Artificial sequence
  SiRNA target sequence
gttttattctgttttctatct

SEQ ID NO: 229535 - DNA, 21 bp, Artificial sequence
  SiRNA target sequence
ttttattctgttttctatctc

SEQ ID NO: 229536 - DNA, 21 bp, Artificial sequence
  SiRNA target sequence
tttattctgttttctatctca

SEQ ID NO: 229537 - DNA, 21 bp, Artificial sequence
  SiRNA target sequence
ttattctgttttctatctcaa

SEQ ID NO: 229538 - DNA, 21 bp, Artificial sequence
  SiRNA target sequence
tattctgttttctatctcaat

SEQ ID NO: 229539 - DNA, 21 bp, Artificial sequence
  SiRNA target sequence
attctgttttctatctcaata

SEQ ID NO: 229540 - DNA, 21 bp, Artificial sequence
  SiRNA target sequence
ttctgttttctatctcaatag

SEQ ID NO: 229541 - DNA, 21 bp, Artificial sequence
  SiRNA target sequence
tctgttttctatctcaataga

SEQ ID NO: 229542 - DNA, 21 bp, Artificial sequence
  SiRNA target sequence
ctgttttctatctcaatagaa

SEQ ID NO: 229543 - DNA, 21 bp, Artificial sequence
  SiRNA target sequence
tgttttctatctcaatagaaa

SEQ ID NO: 229544 - DNA, 21 bp, Artificial sequence
  SiRNA target sequence
gttttctatctcaatagaaaa

SEQ ID NO: 229545 - DNA, 21 bp, Artificial sequence
  SiRNA target sequence
ttttctatctcaatagaaaat

SEQ ID NO: 229546 - DNA, 21 bp, Artificial sequence
  SiRNA target sequence
tttctatctcaatagaaaata

SEQ ID NO: 229547 - DNA, 21 bp, Artificial sequence
  SiRNA target sequence
ttctatctcaatagaaaatat

SEQ ID NO: 229548 - DNA, 21 bp, Artificial sequence
  SiRNA target sequence
tctatctcaatagaaaatata

SEQ ID NO: 229549 - DNA, 21 bp, Artificial sequence
  SiRNA target sequence
ctatctcaatagaaaatataa

SEQ ID NO: 229550 - DNA, 21 bp, Artificial sequence
  SiRNA target sequence
tatctcaatagaaaatataaa

SEQ ID NO: 229551 - DNA, 21 bp, Artificial sequence
  SiRNA target sequence
atctcaatagaaaatataaag

SEQ ID NO: 229552 - DNA, 21 bp, Artificial sequence
  SiRNA target sequence
tctcaatagaaaatataaaga

SEQ ID NO: 229553 - DNA, 21 bp, Artificial sequence
  SiRNA target sequence
ctcaatagaaaatataaagaa

SEQ ID NO: 229554 - DNA, 21 bp, Artificial sequence
  SiRNA target sequence
tcaatagaaaatataaagaat

SEQ ID NO: 229555 - DNA, 21 bp, Artificial sequence
  SiRNA target sequence
caatagaaaatataaagaatc

SEQ ID NO: 229556 - DNA, 21 bp, Artificial sequence
  SiRNA target sequence
aatagaaaatataaagaatct

SEQ ID NO: 229557 - DNA, 21 bp, Artificial sequence
  SiRNA target sequence
atagaaaatataaagaatctg

SEQ ID NO: 229558 - DNA, 21 bp, Artificial sequence
  SiRNA target sequence
tagaaaatataaagaatctgt

SEQ ID NO: 229559 - DNA, 21 bp, Artificial sequence
  SiRNA target sequence
agaaaatataaagaatctgtc

SEQ ID NO: 229560 - DNA, 21 bp, Artificial sequence
  SiRNA target sequence
gaaaatataaagaatctgtcg

SEQ ID NO: 229561 - DNA, 21 bp, Artificial sequence
  SiRNA target sequence
aaaatataaagaatctgtcga

SEQ ID NO: 229562 - DNA, 21 bp, Artificial sequence
  SiRNA target sequence
aaatataaagaatctgtcgag

SEQ ID NO: 229563 - DNA, 21 bp, Artificial sequence
  SiRNA target sequence
aatataaagaatctgtcgaga

SEQ ID NO: 229564 - DNA, 21 bp, Artificial sequence
  SiRNA target sequence
atataaagaatctgtcgagaa

SEQ ID NO: 229565 - DNA, 21 bp, Artificial sequence
  SiRNA target sequence
tataaagaatctgtcgagaat

SEQ ID NO: 229566 - DNA, 21 bp, Artificial sequence
  SiRNA target sequence
ataaagaatctgtcgagaata

SEQ ID NO: 229567 - DNA, 21 bp, Artificial sequence
  SiRNA target sequence
taaagaatctgtcgagaataa

SEQ ID NO: 229568 - DNA, 21 bp, Artificial sequence
  SiRNA target sequence
aaagaatctgtcgagaataat

SEQ ID NO: 229569 - DNA, 21 bp, Artificial sequence
  SiRNA target sequence
aagaatctgtcgagaataatg

SEQ ID NO: 229570 - DNA, 21 bp, Artificial sequence
  SiRNA target sequence
agaatctgtcgagaataatgc

SEQ ID NO: 229571 - DNA, 21 bp, Artificial sequence
  SiRNA target sequence
gaatctgtcgagaataatgca

SEQ ID NO: 229572 - DNA, 21 bp, Artificial sequence
  SiRNA target sequence
aatctgtcgagaataatgcac

SEQ ID NO: 229573 - DNA, 21 bp, Artificial sequence
  SiRNA target sequence
atctgtcgagaataatgcacc

SEQ ID NO: 229574 - DNA, 21 bp, Artificial sequence
  SiRNA target sequence
tctgtcgagaataatgcacca

SEQ ID NO: 229575 - DNA, 21 bp, Artificial sequence
  SiRNA target sequence
ctgtcgagaataatgcaccaa

SEQ ID NO: 229576 - DNA, 21 bp, Artificial sequence
  SiRNA target sequence
tgtcgagaataatgcaccaat

SEQ ID NO: 229577 - DNA, 21 bp, Artificial sequence
  SiRNA target sequence
gtcgagaataatgcaccaatt

SEQ ID NO: 229578 - DNA, 21 bp, Artificial sequence
  SiRNA target sequence
tcgagaataatgcaccaattg

SEQ ID NO: 229579 - DNA, 21 bp, Artificial sequence
  SiRNA target sequence
cgagaataatgcaccaattga

SEQ ID NO: 229580 - DNA, 21 bp, Artificial sequence
  SiRNA target sequence
gagaataatgcaccaattgat

SEQ ID NO: 229581 - DNA, 21 bp, Artificial sequence
  SiRNA target sequence
agaataatgcaccaattgata

SEQ ID NO: 229582 - DNA, 21 bp, Artificial sequence
  SiRNA target sequence
gaataatgcaccaattgatat

SEQ ID NO: 229583 - DNA, 21 bp, Artificial sequence
  SiRNA target sequence
aataatgcaccaattgatatt

SEQ ID NO: 229584 - DNA, 21 bp, Artificial sequence
  SiRNA target sequence
ataatgcaccaattgatattg

SEQ ID NO: 229585 - DNA, 21 bp, Artificial sequence
  SiRNA target sequence
taatgcaccaattgatattga

SEQ ID NO: 229586 - DNA, 21 bp, Artificial sequence
  SiRNA target sequence
aatgcaccaattgatattgat

SEQ ID NO: 229587 - DNA, 21 bp, Artificial sequence
  SiRNA target sequence
atgcaccaattgatattgatt

SEQ ID NO: 229588 - DNA, 21 bp, Artificial sequence
  SiRNA target sequence
tgcaccaattgatattgattt

SEQ ID NO: 229589 - DNA, 21 bp, Artificial sequence
  SiRNA target sequence
gcaccaattgatattgattta

SEQ ID NO: 229590 - DNA, 21 bp, Artificial sequence
  SiRNA target sequence
caccaattgatattgatttat

SEQ ID NO: 229591 - DNA, 21 bp, Artificial sequence
  SiRNA target sequence
accaattgatattgatttatt

SEQ ID NO: 229592 - DNA, 21 bp, Artificial sequence
  SiRNA target sequence
ccaattgatattgatttattc

SEQ ID NO: 229593 - DNA, 21 bp, Artificial sequence
  SiRNA target sequence
caattgatattgatttattca

SEQ ID NO: 229594 - DNA, 21 bp, Artificial sequence
  SiRNA target sequence
aattgatattgatttattcac

SEQ ID NO: 229595 - DNA, 21 bp, Artificial sequence
  SiRNA target sequence
attgatattgatttattcact

SEQ ID NO: 229596 - DNA, 21 bp, Artificial sequence
  SiRNA target sequence
ttgatattgatttattcacta

SEQ ID NO: 229597 - DNA, 21 bp, Artificial sequence
  SiRNA target sequence
tgatattgatttattcactag

SEQ ID NO: 229598 - DNA, 21 bp, Artificial sequence
  SiRNA target sequence
gatattgatttattcactagt

SEQ ID NO: 229599 - DNA, 21 bp, Artificial sequence
  SiRNA target sequence
atattgatttattcactagtt

SEQ ID NO: 229600 - DNA, 21 bp, Artificial sequence
  SiRNA target sequence
tattgatttattcactagttc

SEQ ID NO: 229601 - DNA, 21 bp, Artificial sequence
  SiRNA target sequence
attgatttattcactagttca

SEQ ID NO: 229602 - DNA, 21 bp, Artificial sequence
  SiRNA target sequence
ttgatttattcactagttcaa

SEQ ID NO: 229603 - DNA, 21 bp, Artificial sequence
  SiRNA target sequence
tgatttattcactagttcaaa

SEQ ID NO: 229604 - DNA, 21 bp, Artificial sequence
  SiRNA target sequence
gatttattcactagttcaaaa

SEQ ID NO: 229605 - DNA, 21 bp, Artificial sequence
  SiRNA target sequence
atttattcactagttcaaaag

SEQ ID NO: 229606 - DNA, 21 bp, Artificial sequence
  SiRNA target sequence
tttattcactagttcaaaagt

SEQ ID NO: 229607 - DNA, 21 bp, Artificial sequence
  SiRNA target sequence
ttattcactagttcaaaagtc

SEQ ID NO: 229608 - DNA, 21 bp, Artificial sequence
  SiRNA target sequence
tattcactagttcaaaagtca

SEQ ID NO: 229609 - DNA, 21 bp, Artificial sequence
  SiRNA target sequence
attcactagttcaaaagtcaa

SEQ ID NO: 229610 - DNA, 21 bp, Artificial sequence
  SiRNA target sequence
ttcactagttcaaaagtcaag

SEQ ID NO: 229611 - DNA, 21 bp, Artificial sequence
  SiRNA target sequence
tcactagttcaaaagtcaagg

SEQ ID NO: 229612 - DNA, 21 bp, Artificial sequence
  SiRNA target sequence
cactagttcaaaagtcaaggc

SEQ ID NO: 229613 - DNA, 21 bp, Artificial sequence
  SiRNA target sequence
actagttcaaaagtcaaggca

SEQ ID NO: 229614 - DNA, 21 bp, Artificial sequence
  SiRNA target sequence
ctagttcaaaagtcaaggcac

SEQ ID NO: 229615 - DNA, 21 bp, Artificial sequence
  SiRNA target sequence
tagttcaaaagtcaaggcacc

SEQ ID NO: 229616 - DNA, 21 bp, Artificial sequence
  SiRNA target sequence
agttcaaaagtcaaggcacct

SEQ ID NO: 229617 - DNA, 21 bp, Artificial sequence
  SiRNA target sequence
gttcaaaagtcaaggcacctt

SEQ ID NO: 229618 - DNA, 21 bp, Artificial sequence
  SiRNA target sequence
ttcaaaagtcaaggcaccttc

SEQ ID NO: 229619 - DNA, 21 bp, Artificial sequence
  SiRNA target sequence
tcaaaagtcaaggcaccttct

SEQ ID NO: 229620 - DNA, 21 bp, Artificial sequence
  SiRNA target sequence
caaaagtcaaggcaccttctt

SEQ ID NO: 229621 - DNA, 21 bp, Artificial sequence
  SiRNA target sequence
aaaagtcaaggcaccttcttc

SEQ ID NO: 229622 - DNA, 21 bp, Artificial sequence
  SiRNA target sequence
aaagtcaaggcaccttcttct

SEQ ID NO: 229623 - DNA, 21 bp, Artificial sequence
  SiRNA target sequence
aagtcaaggcaccttcttctg

SEQ ID NO: 229624 - DNA, 21 bp, Artificial sequence
  SiRNA target sequence
agtcaaggcaccttcttctga

SEQ ID NO: 229625 - DNA, 21 bp, Artificial sequence
  SiRNA target sequence
gtcaaggcaccttcttctgaa

SEQ ID NO: 229626 - DNA, 21 bp, Artificial sequence
  SiRNA target sequence
tcaaggcaccttcttctgaac

SEQ ID NO: 229627 - DNA, 21 bp, Artificial sequence
  SiRNA target sequence
caaggcaccttcttctgaacc

SEQ ID NO: 229628 - DNA, 21 bp, Artificial sequence
  SiRNA target sequence
aaggcaccttcttctgaacct

SEQ ID NO: 229629 - DNA, 21 bp, Artificial sequence
  SiRNA target sequence
aggcaccttcttctgaaccta

SEQ ID NO: 229630 - DNA, 21 bp, Artificial sequence
  SiRNA target sequence
ggcaccttcttctgaacctac

SEQ ID NO: 229631 - DNA, 21 bp, Artificial sequence
  SiRNA target sequence
gcaccttcttctgaacctact

SEQ ID NO: 229632 - DNA, 21 bp, Artificial sequence
  SiRNA target sequence
caccttcttctgaacctactg

SEQ ID NO: 229633 - DNA, 21 bp, Artificial sequence
  SiRNA target sequence
accttcttctgaacctactgt

SEQ ID NO: 229634 - DNA, 21 bp, Artificial sequence
  SiRNA target sequence
ccttcttctgaacctactgtt

SEQ ID NO: 229635 - DNA, 21 bp, Artificial sequence
  SiRNA target sequence
cttcttctgaacctactgttg

SEQ ID NO: 229636 - DNA, 21 bp, Artificial sequence
  SiRNA target sequence
ttcttctgaacctactgttgc

SEQ ID NO: 229637 - DNA, 21 bp, Artificial sequence
  SiRNA target sequence
tcttctgaacctactgttgct

SEQ ID NO: 229638 - DNA, 21 bp, Artificial sequence
  SiRNA target sequence
cttctgaacctactgttgcta

SEQ ID NO: 229639 - DNA, 21 bp, Artificial sequence
  SiRNA target sequence
ttctgaacctactgttgctac

SEQ ID NO: 229640 - DNA, 21 bp, Artificial sequence
  SiRNA target sequence
tctgaacctactgttgctacc

SEQ ID NO: 229641 - DNA, 21 bp, Artificial sequence
  SiRNA target sequence
ctgaacctactgttgctacca

SEQ ID NO: 229642 - DNA, 21 bp, Artificial sequence
  SiRNA target sequence
tgaacctactgttgctaccaa

SEQ ID NO: 229643 - DNA, 21 bp, Artificial sequence
  SiRNA target sequence
gaacctactgttgctaccaaa

SEQ ID NO: 229644 - DNA, 21 bp, Artificial sequence
  SiRNA target sequence
aacctactgttgctaccaaaa

SEQ ID NO: 229645 - DNA, 21 bp, Artificial sequence
  SiRNA target sequence
acctactgttgctaccaaaag

SEQ ID NO: 229646 - DNA, 21 bp, Artificial sequence
  SiRNA target sequence
cctactgttgctaccaaaagt

SEQ ID NO: 229647 - DNA, 21 bp, Artificial sequence
  SiRNA target sequence
ctactgttgctaccaaaagtg

SEQ ID NO: 229648 - DNA, 21 bp, Artificial sequence
  SiRNA target sequence
tactgttgctaccaaaagtgt

SEQ ID NO: 229649 - DNA, 21 bp, Artificial sequence
  SiRNA target sequence
actgttgctaccaaaagtgtt

SEQ ID NO: 229650 - DNA, 21 bp, Artificial sequence
  SiRNA target sequence
ctgttgctaccaaaagtgtta

SEQ ID NO: 229651 - DNA, 21 bp, Artificial sequence
  SiRNA target sequence
tgttgctaccaaaagtgttac

SEQ ID NO: 229652 - DNA, 21 bp, Artificial sequence
  SiRNA target sequence
gttgctaccaaaagtgttact

SEQ ID NO: 229653 - DNA, 21 bp, Artificial sequence
  SiRNA target sequence
ttgctaccaaaagtgttacta

SEQ ID NO: 229654 - DNA, 21 bp, Artificial sequence
  SiRNA target sequence
tgctaccaaaagtgttactac

SEQ ID NO: 229655 - DNA, 21 bp, Artificial sequence
  SiRNA target sequence
gctaccaaaagtgttactaca

SEQ ID NO: 229656 - DNA, 21 bp, Artificial sequence
  SiRNA target sequence
ctaccaaaagtgttactacag

SEQ ID NO: 229657 - DNA, 21 bp, Artificial sequence
  SiRNA target sequence
taccaaaagtgttactacaga

SEQ ID NO: 229658 - DNA, 21 bp, Artificial sequence
  SiRNA target sequence
accaaaagtgttactacagaa

SEQ ID NO: 229659 - DNA, 21 bp, Artificial sequence
  SiRNA target sequence
ccaaaagtgttactacagaag

SEQ ID NO: 229660 - DNA, 21 bp, Artificial sequence
  SiRNA target sequence
caaaagtgttactacagaaga

SEQ ID NO: 229661 - DNA, 21 bp, Artificial sequence
  SiRNA target sequence
aaaagtgttactacagaagaa

SEQ ID NO: 229662 - DNA, 21 bp, Artificial sequence
  SiRNA target sequence
aaagtgttactacagaagaat

SEQ ID NO: 229663 - DNA, 21 bp, Artificial sequence
  SiRNA target sequence
aagtgttactacagaagaata

SEQ ID NO: 229664 - DNA, 21 bp, Artificial sequence
  SiRNA target sequence
agtgttactacagaagaataa

SEQ ID NO: 229665 - DNA, 22 bp, Artificial sequence
  SiRNA target sequence
atgtcagtagacaattcgaaag

SEQ ID NO: 229666 - DNA, 22 bp, Artificial sequence
  SiRNA target sequence
tgtcagtagacaattcgaaagt

SEQ ID NO: 229667 - DNA, 22 bp, Artificial sequence
  SiRNA target sequence
gtcagtagacaattcgaaagtt

SEQ ID NO: 229668 - DNA, 22 bp, Artificial sequence
  SiRNA target sequence
tcagtagacaattcgaaagttc

SEQ ID NO: 229669 - DNA, 22 bp, Artificial sequence
  SiRNA target sequence
cagtagacaattcgaaagttct

SEQ ID NO: 229670 - DNA, 22 bp, Artificial sequence
  SiRNA target sequence
agtagacaattcgaaagttcta

SEQ ID NO: 229671 - DNA, 22 bp, Artificial sequence
  SiRNA target sequence
gtagacaattcgaaagttctac

SEQ ID NO: 229672 - DNA, 22 bp, Artificial sequence
  SiRNA target sequence
tagacaattcgaaagttctaca

SEQ ID NO: 229673 - DNA, 22 bp, Artificial sequence
  SiRNA target sequence
agacaattcgaaagttctacaa

SEQ ID NO: 229674 - DNA, 22 bp, Artificial sequence
  SiRNA target sequence
gacaattcgaaagttctacaaa

SEQ ID NO: 229675 - DNA, 22 bp, Artificial sequence
  SiRNA target sequence
acaattcgaaagttctacaaaa

SEQ ID NO: 229676 - DNA, 22 bp, Artificial sequence
  SiRNA target sequence
caattcgaaagttctacaaaat

SEQ ID NO: 229677 - DNA, 22 bp, Artificial sequence
  SiRNA target sequence
aattcgaaagttctacaaaata

SEQ ID NO: 229678 - DNA, 22 bp, Artificial sequence
  SiRNA target sequence
attcgaaagttctacaaaataa

SEQ ID NO: 229679 - DNA, 22 bp, Artificial sequence
  SiRNA target sequence
ttcgaaagttctacaaaataac

SEQ ID NO: 229680 - DNA, 22 bp, Artificial sequence
  SiRNA target sequence
tcgaaagttctacaaaataacg

SEQ ID NO: 229681 - DNA, 22 bp, Artificial sequence
  SiRNA target sequence
cgaaagttctacaaaataacga

SEQ ID NO: 229682 - DNA, 22 bp, Artificial sequence
  SiRNA target sequence
gaaagttctacaaaataacgaa

SEQ ID NO: 229683 - DNA, 22 bp, Artificial sequence
  SiRNA target sequence
aaagttctacaaaataacgaaa

SEQ ID NO: 229684 - DNA, 22 bp, Artificial sequence
  SiRNA target sequence
aagttctacaaaataacgaaaa

SEQ ID NO: 229685 - DNA, 22 bp, Artificial sequence
  SiRNA target sequence
agttctacaaaataacgaaaac

SEQ ID NO: 229686 - DNA, 22 bp, Artificial sequence
  SiRNA target sequence
gttctacaaaataacgaaaact

SEQ ID NO: 229687 - DNA, 22 bp, Artificial sequence
  SiRNA target sequence
ttctacaaaataacgaaaactc

SEQ ID NO: 229688 - DNA, 22 bp, Artificial sequence
  SiRNA target sequence
tctacaaaataacgaaaactct

SEQ ID NO: 229689 - DNA, 22 bp, Artificial sequence
  SiRNA target sequence
ctacaaaataacgaaaactctg

SEQ ID NO: 229690 - DNA, 22 bp, Artificial sequence
  SiRNA target sequence
tacaaaataacgaaaactctgc

SEQ ID NO: 229691 - DNA, 22 bp, Artificial sequence
  SiRNA target sequence
acaaaataacgaaaactctgct

SEQ ID NO: 229692 - DNA, 22 bp, Artificial sequence
  SiRNA target sequence
caaaataacgaaaactctgctc

SEQ ID NO: 229693 - DNA, 22 bp, Artificial sequence
  SiRNA target sequence
aaaataacgaaaactctgctct

SEQ ID NO: 229694 - DNA, 22 bp, Artificial sequence
  SiRNA target sequence
aaataacgaaaactctgctctt

SEQ ID NO: 229695 - DNA, 22 bp, Artificial sequence
  SiRNA target sequence
aataacgaaaactctgctcttc

SEQ ID NO: 229696 - DNA, 22 bp, Artificial sequence
  SiRNA target sequence
ataacgaaaactctgctcttcc

SEQ ID NO: 229697 - DNA, 22 bp, Artificial sequence
  SiRNA target sequence
taacgaaaactctgctcttcct

SEQ ID NO: 229698 - DNA, 22 bp, Artificial sequence
  SiRNA target sequence
aacgaaaactctgctcttccta

SEQ ID NO: 229699 - DNA, 22 bp, Artificial sequence
  SiRNA target sequence
acgaaaactctgctcttcctac

SEQ ID NO: 229700 - DNA, 22 bp, Artificial sequence
  SiRNA target sequence
cgaaaactctgctcttcctaca

SEQ ID NO: 229701 - DNA, 22 bp, Artificial sequence
  SiRNA target sequence
gaaaactctgctcttcctacag

SEQ ID NO: 229702 - DNA, 22 bp, Artificial sequence
  SiRNA target sequence
aaaactctgctcttcctacaga

SEQ ID NO: 229703 - DNA, 22 bp, Artificial sequence
  SiRNA target sequence
aaactctgctcttcctacagaa

SEQ ID NO: 229704 - DNA, 22 bp, Artificial sequence
  SiRNA target sequence
aactctgctcttcctacagaag

SEQ ID NO: 229705 - DNA, 22 bp, Artificial sequence
  SiRNA target sequence
actctgctcttcctacagaaga

SEQ ID NO: 229706 - DNA, 22 bp, Artificial sequence
  SiRNA target sequence
ctctgctcttcctacagaagat

SEQ ID NO: 229707 - DNA, 22 bp, Artificial sequence
  SiRNA target sequence
tctgctcttcctacagaagatg

SEQ ID NO: 229708 - DNA, 22 bp, Artificial sequence
  SiRNA target sequence
ctgctcttcctacagaagatga

SEQ ID NO: 229709 - DNA, 22 bp, Artificial sequence
  SiRNA target sequence
tgctcttcctacagaagatgaa

SEQ ID NO: 229710 - DNA, 22 bp, Artificial sequence
  SiRNA target sequence
gctcttcctacagaagatgaaa

SEQ ID NO: 229711 - DNA, 22 bp, Artificial sequence
  SiRNA target sequence
ctcttcctacagaagatgaaat

SEQ ID NO: 229712 - DNA, 22 bp, Artificial sequence
  SiRNA target sequence
tcttcctacagaagatgaaatt

SEQ ID NO: 229713 - DNA, 22 bp, Artificial sequence
  SiRNA target sequence
cttcctacagaagatgaaattg

SEQ ID NO: 229714 - DNA, 22 bp, Artificial sequence
  SiRNA target sequence
ttcctacagaagatgaaattga

SEQ ID NO: 229715 - DNA, 22 bp, Artificial sequence
  SiRNA target sequence
tcctacagaagatgaaattgag

SEQ ID NO: 229716 - DNA, 22 bp, Artificial sequence
  SiRNA target sequence
cctacagaagatgaaattgagt

SEQ ID NO: 229717 - DNA, 22 bp, Artificial sequence
  SiRNA target sequence
ctacagaagatgaaattgagta

SEQ ID NO: 229718 - DNA, 22 bp, Artificial sequence
  SiRNA target sequence
tacagaagatgaaattgagtat

SEQ ID NO: 229719 - DNA, 22 bp, Artificial sequence
  SiRNA target sequence
acagaagatgaaattgagtatg

SEQ ID NO: 229720 - DNA, 22 bp, Artificial sequence
  SiRNA target sequence
cagaagatgaaattgagtatga

SEQ ID NO: 229721 - DNA, 22 bp, Artificial sequence
  SiRNA target sequence
agaagatgaaattgagtatgag

SEQ ID NO: 229722 - DNA, 22 bp, Artificial sequence
  SiRNA target sequence
gaagatgaaattgagtatgagg

SEQ ID NO: 229723 - DNA, 22 bp, Artificial sequence
  SiRNA target sequence
aagatgaaattgagtatgaggc

SEQ ID NO: 229724 - DNA, 22 bp, Artificial sequence
  SiRNA target sequence
agatgaaattgagtatgaggcc

SEQ ID NO: 229725 - DNA, 22 bp, Artificial sequence
  SiRNA target sequence
gatgaaattgagtatgaggcca

SEQ ID NO: 229726 - DNA, 22 bp, Artificial sequence
  SiRNA target sequence
atgaaattgagtatgaggccag

SEQ ID NO: 229727 - DNA, 22 bp, Artificial sequence
  SiRNA target sequence
tgaaattgagtatgaggccagc

SEQ ID NO: 229728 - DNA, 22 bp, Artificial sequence
  SiRNA target sequence
gaaattgagtatgaggccagca

SEQ ID NO: 229729 - DNA, 22 bp, Artificial sequence
  SiRNA target sequence
aaattgagtatgaggccagcaa

SEQ ID NO: 229730 - DNA, 22 bp, Artificial sequence
  SiRNA target sequence
aattgagtatgaggccagcaat

SEQ ID NO: 229731 - DNA, 22 bp, Artificial sequence
  SiRNA target sequence
attgagtatgaggccagcaatg

SEQ ID NO: 229732 - DNA, 22 bp, Artificial sequence
  SiRNA target sequence
ttgagtatgaggccagcaatgg

SEQ ID NO: 229733 - DNA, 22 bp, Artificial sequence
  SiRNA target sequence
tgagtatgaggccagcaatggt

SEQ ID NO: 229734 - DNA, 22 bp, Artificial sequence
  SiRNA target sequence
gagtatgaggccagcaatggtt

SEQ ID NO: 229735 - DNA, 22 bp, Artificial sequence
  SiRNA target sequence
agtatgaggccagcaatggttc

SEQ ID NO: 229736 - DNA, 22 bp, Artificial sequence
  SiRNA target sequence
gtatgaggccagcaatggttct

SEQ ID NO: 229737 - DNA, 22 bp, Artificial sequence
  SiRNA target sequence
tatgaggccagcaatggttctg

SEQ ID NO: 229738 - DNA, 22 bp, Artificial sequence
  SiRNA target sequence
atgaggccagcaatggttctgg

SEQ ID NO: 229739 - DNA, 22 bp, Artificial sequence
  SiRNA target sequence
tgaggccagcaatggttctggt

SEQ ID NO: 229740 - DNA, 22 bp, Artificial sequence
  SiRNA target sequence
gaggccagcaatggttctggta

SEQ ID NO: 229741 - DNA, 22 bp, Artificial sequence
  SiRNA target sequence
aggccagcaatggttctggtat

SEQ ID NO: 229742 - DNA, 22 bp, Artificial sequence
  SiRNA target sequence
ggccagcaatggttctggtata

SEQ ID NO: 229743 - DNA, 22 bp, Artificial sequence
  SiRNA target sequence
gccagcaatggttctggtatat

SEQ ID NO: 229744 - DNA, 22 bp, Artificial sequence
  SiRNA target sequence
ccagcaatggttctggtatata

SEQ ID NO: 229745 - DNA, 22 bp, Artificial sequence
  SiRNA target sequence
cagcaatggttctggtatatat

SEQ ID NO: 229746 - DNA, 22 bp, Artificial sequence
  SiRNA target sequence
agcaatggttctggtatatatt

SEQ ID NO: 229747 - DNA, 22 bp, Artificial sequence
  SiRNA target sequence
gcaatggttctggtatatattc

SEQ ID NO: 229748 - DNA, 22 bp, Artificial sequence
  SiRNA target sequence
caatggttctggtatatattca

SEQ ID NO: 229749 - DNA, 22 bp, Artificial sequence
  SiRNA target sequence
aatggttctggtatatattcac

SEQ ID NO: 229750 - DNA, 22 bp, Artificial sequence
  SiRNA target sequence
atggttctggtatatattcact

SEQ ID NO: 229751 - DNA, 22 bp, Artificial sequence
  SiRNA target sequence
tggttctggtatatattcactt

SEQ ID NO: 229752 - DNA, 22 bp, Artificial sequence
  SiRNA target sequence
ggttctggtatatattcactta

SEQ ID NO: 229753 - DNA, 22 bp, Artificial sequence
  SiRNA target sequence
gttctggtatatattcacttat

SEQ ID NO: 229754 - DNA, 22 bp, Artificial sequence
  SiRNA target sequence
ttctggtatatattcacttatt

SEQ ID NO: 229755 - DNA, 22 bp, Artificial sequence
  SiRNA target sequence
tctggtatatattcacttatta

SEQ ID NO: 229756 - DNA, 22 bp, Artificial sequence
  SiRNA target sequence
ctggtatatattcacttattag

SEQ ID NO: 229757 - DNA, 22 bp, Artificial sequence
  SiRNA target sequence
tggtatatattcacttattaga

SEQ ID NO: 229758 - DNA, 22 bp, Artificial sequence
  SiRNA target sequence
ggtatatattcacttattagag

SEQ ID NO: 229759 - DNA, 22 bp, Artificial sequence
  SiRNA target sequence
gtatatattcacttattagagt

SEQ ID NO: 229760 - DNA, 22 bp, Artificial sequence
  SiRNA target sequence
tatatattcacttattagagta

SEQ ID NO: 229761 - DNA, 22 bp, Artificial sequence
  SiRNA target sequence
atatattcacttattagagtag

SEQ ID NO: 229762 - DNA, 22 bp, Artificial sequence
  SiRNA target sequence
tatattcacttattagagtagc

SEQ ID NO: 229763 - DNA, 22 bp, Artificial sequence
  SiRNA target sequence
atattcacttattagagtagca

SEQ ID NO: 229764 - DNA, 22 bp, Artificial sequence
  SiRNA target sequence
tattcacttattagagtagcaa

SEQ ID NO: 229765 - DNA, 22 bp, Artificial sequence
  SiRNA target sequence
attcacttattagagtagcaaa

SEQ ID NO: 229766 - DNA, 22 bp, Artificial sequence
  SiRNA target sequence
ttcacttattagagtagcaaag

SEQ ID NO: 229767 - DNA, 22 bp, Artificial sequence
  SiRNA target sequence
tcacttattagagtagcaaagg

SEQ ID NO: 229768 - DNA, 22 bp, Artificial sequence
  SiRNA target sequence
cacttattagagtagcaaaggt

SEQ ID NO: 229769 - DNA, 22 bp, Artificial sequence
  SiRNA target sequence
acttattagagtagcaaaggtt

SEQ ID NO: 229770 - DNA, 22 bp, Artificial sequence
  SiRNA target sequence
cttattagagtagcaaaggttg

SEQ ID NO: 229771 - DNA, 22 bp, Artificial sequence
  SiRNA target sequence
ttattagagtagcaaaggttga

SEQ ID NO: 229772 - DNA, 22 bp, Artificial sequence
  SiRNA target sequence
tattagagtagcaaaggttgag

SEQ ID NO: 229773 - DNA, 22 bp, Artificial sequence
  SiRNA target sequence
attagagtagcaaaggttgaga

SEQ ID NO: 229774 - DNA, 22 bp, Artificial sequence
  SiRNA target sequence
ttagagtagcaaaggttgagag

SEQ ID NO: 229775 - DNA, 22 bp, Artificial sequence
  SiRNA target sequence
tagagtagcaaaggttgagaga

SEQ ID NO: 229776 - DNA, 22 bp, Artificial sequence
  SiRNA target sequence
agagtagcaaaggttgagagaa

SEQ ID NO: 229777 - DNA, 22 bp, Artificial sequence
  SiRNA target sequence
gagtagcaaaggttgagagaaa

SEQ ID NO: 229778 - DNA, 22 bp, Artificial sequence
  SiRNA target sequence
agtagcaaaggttgagagaaag

SEQ ID NO: 229779 - DNA, 22 bp, Artificial sequence
  SiRNA target sequence
gtagcaaaggttgagagaaaga

SEQ ID NO: 229780 - DNA, 22 bp, Artificial sequence
  SiRNA target sequence
tagcaaaggttgagagaaagat

SEQ ID NO: 229781 - DNA, 22 bp, Artificial sequence
  SiRNA target sequence
agcaaaggttgagagaaagatg

SEQ ID NO: 229782 - DNA, 22 bp, Artificial sequence
  SiRNA target sequence
gcaaaggttgagagaaagatgt

SEQ ID NO: 229783 - DNA, 22 bp, Artificial sequence
  SiRNA target sequence
caaaggttgagagaaagatgtt

SEQ ID NO: 229784 - DNA, 22 bp, Artificial sequence
  SiRNA target sequence
aaaggttgagagaaagatgttt

SEQ ID NO: 229785 - DNA, 22 bp, Artificial sequence
  SiRNA target sequence
aaggttgagagaaagatgtttt

SEQ ID NO: 229786 - DNA, 22 bp, Artificial sequence
  SiRNA target sequence
aggttgagagaaagatgttttg

SEQ ID NO: 229787 - DNA, 22 bp, Artificial sequence
  SiRNA target sequence
ggttgagagaaagatgttttgg

SEQ ID NO: 229788 - DNA, 22 bp, Artificial sequence
  SiRNA target sequence
gttgagagaaagatgttttgga

SEQ ID NO: 229789 - DNA, 22 bp, Artificial sequence
  SiRNA target sequence
ttgagagaaagatgttttggat

SEQ ID NO: 229790 - DNA, 22 bp, Artificial sequence
  SiRNA target sequence
tgagagaaagatgttttggatc

SEQ ID NO: 229791 - DNA, 22 bp, Artificial sequence
  SiRNA target sequence
gagagaaagatgttttggatca

SEQ ID NO: 229792 - DNA, 22 bp, Artificial sequence
  SiRNA target sequence
agagaaagatgttttggatcat

SEQ ID NO: 229793 - DNA, 22 bp, Artificial sequence
  SiRNA target sequence
gagaaagatgttttggatcatg

SEQ ID NO: 229794 - DNA, 22 bp, Artificial sequence
  SiRNA target sequence
agaaagatgttttggatcatgg

SEQ ID NO: 229795 - DNA, 22 bp, Artificial sequence
  SiRNA target sequence
gaaagatgttttggatcatggc

SEQ ID NO: 229796 - DNA, 22 bp, Artificial sequence
  SiRNA target sequence
aaagatgttttggatcatggca

SEQ ID NO: 229797 - DNA, 22 bp, Artificial sequence
  SiRNA target sequence
aagatgttttggatcatggcag

SEQ ID NO: 229798 - DNA, 22 bp, Artificial sequence
  SiRNA target sequence
agatgttttggatcatggcagc

SEQ ID NO: 229799 - DNA, 22 bp, Artificial sequence
  SiRNA target sequence
gatgttttggatcatggcagct

SEQ ID NO: 229800 - DNA, 22 bp, Artificial sequence
  SiRNA target sequence
atgttttggatcatggcagcta

SEQ ID NO: 229801 - DNA, 22 bp, Artificial sequence
  SiRNA target sequence
tgttttggatcatggcagctat

SEQ ID NO: 229802 - DNA, 22 bp, Artificial sequence
  SiRNA target sequence
gttttggatcatggcagctatg

SEQ ID NO: 229803 - DNA, 22 bp, Artificial sequence
  SiRNA target sequence
ttttggatcatggcagctatgt

SEQ ID NO: 229804 - DNA, 22 bp, Artificial sequence
  SiRNA target sequence
tttggatcatggcagctatgtt

SEQ ID NO: 229805 - DNA, 22 bp, Artificial sequence
  SiRNA target sequence
ttggatcatggcagctatgttc

SEQ ID NO: 229806 - DNA, 22 bp, Artificial sequence
  SiRNA target sequence
tggatcatggcagctatgttct

SEQ ID NO: 229807 - DNA, 22 bp, Artificial sequence
  SiRNA target sequence
ggatcatggcagctatgttctt

SEQ ID NO: 229808 - DNA, 22 bp, Artificial sequence
  SiRNA target sequence
gatcatggcagctatgttcttt

SEQ ID NO: 229809 - DNA, 22 bp, Artificial sequence
  SiRNA target sequence
atcatggcagctatgttcttta

SEQ ID NO: 229810 - DNA, 22 bp, Artificial sequence
  SiRNA target sequence
tcatggcagctatgttctttat

SEQ ID NO: 229811 - DNA, 22 bp, Artificial sequence
  SiRNA target sequence
catggcagctatgttctttatt

SEQ ID NO: 229812 - DNA, 22 bp, Artificial sequence
  SiRNA target sequence
atggcagctatgttctttatta

SEQ ID NO: 229813 - DNA, 22 bp, Artificial sequence
  SiRNA target sequence
tggcagctatgttctttattat

SEQ ID NO: 229814 - DNA, 22 bp, Artificial sequence
  SiRNA target sequence
ggcagctatgttctttattatc

SEQ ID NO: 229815 - DNA, 22 bp, Artificial sequence
  SiRNA target sequence
gcagctatgttctttattatct

SEQ ID NO: 229816 - DNA, 22 bp, Artificial sequence
  SiRNA target sequence
cagctatgttctttattatctc

SEQ ID NO: 229817 - DNA, 22 bp, Artificial sequence
  SiRNA target sequence
agctatgttctttattatctcc

SEQ ID NO: 229818 - DNA, 22 bp, Artificial sequence
  SiRNA target sequence
gctatgttctttattatctcct

SEQ ID NO: 229819 - DNA, 22 bp, Artificial sequence
  SiRNA target sequence
ctatgttctttattatctcctt

SEQ ID NO: 229820 - DNA, 22 bp, Artificial sequence
  SiRNA target sequence
tatgttctttattatctccttt

SEQ ID NO: 229821 - DNA, 22 bp, Artificial sequence
  SiRNA target sequence
atgttctttattatctccttta

SEQ ID NO: 229822 - DNA, 22 bp, Artificial sequence
  SiRNA target sequence
tgttctttattatctcctttat

SEQ ID NO: 229823 - DNA, 22 bp, Artificial sequence
  SiRNA target sequence
gttctttattatctcctttatt

SEQ ID NO: 229824 - DNA, 22 bp, Artificial sequence
  SiRNA target sequence
ttctttattatctcctttattt

SEQ ID NO: 229825 - DNA, 22 bp, Artificial sequence
  SiRNA target sequence
tctttattatctcctttattta

SEQ ID NO: 229826 - DNA, 22 bp, Artificial sequence
  SiRNA target sequence
ctttattatctcctttatttat

SEQ ID NO: 229827 - DNA, 22 bp, Artificial sequence
  SiRNA target sequence
tttattatctcctttatttatt

SEQ ID NO: 229828 - DNA, 22 bp, Artificial sequence
  SiRNA target sequence
ttattatctcctttatttattc

SEQ ID NO: 229829 - DNA, 22 bp, Artificial sequence
  SiRNA target sequence
tattatctcctttatttattcg

SEQ ID NO: 229830 - DNA, 22 bp, Artificial sequence
  SiRNA target sequence
attatctcctttatttattcgg

SEQ ID NO: 229831 - DNA, 22 bp, Artificial sequence
  SiRNA target sequence
ttatctcctttatttattcggt

SEQ ID NO: 229832 - DNA, 22 bp, Artificial sequence
  SiRNA target sequence
tatctcctttatttattcggtg

SEQ ID NO: 229833 - DNA, 22 bp, Artificial sequence
  SiRNA target sequence
atctcctttatttattcggtgg

SEQ ID NO: 229834 - DNA, 22 bp, Artificial sequence
  SiRNA target sequence
tctcctttatttattcggtggc

SEQ ID NO: 229835 - DNA, 22 bp, Artificial sequence
  SiRNA target sequence
ctcctttatttattcggtggct

SEQ ID NO: 229836 - DNA, 22 bp, Artificial sequence
  SiRNA target sequence
tcctttatttattcggtggcta

SEQ ID NO: 229837 - DNA, 22 bp, Artificial sequence
  SiRNA target sequence
cctttatttattcggtggctag

SEQ ID NO: 229838 - DNA, 22 bp, Artificial sequence
  SiRNA target sequence
ctttatttattcggtggctaga

SEQ ID NO: 229839 - DNA, 22 bp, Artificial sequence
  SiRNA target sequence
tttatttattcggtggctagag

SEQ ID NO: 229840 - DNA, 22 bp, Artificial sequence
  SiRNA target sequence
ttatttattcggtggctagagt

SEQ ID NO: 229841 - DNA, 22 bp, Artificial sequence
  SiRNA target sequence
tatttattcggtggctagagtg

SEQ ID NO: 229842 - DNA, 22 bp, Artificial sequence
  SiRNA target sequence
atttattcggtggctagagtgc

SEQ ID NO: 229843 - DNA, 22 bp, Artificial sequence
  SiRNA target sequence
tttattcggtggctagagtgct

SEQ ID NO: 229844 - DNA, 22 bp, Artificial sequence
  SiRNA target sequence
ttattcggtggctagagtgctt

SEQ ID NO: 229845 - DNA, 22 bp, Artificial sequence
  SiRNA target sequence
tattcggtggctagagtgctta

SEQ ID NO: 229846 - DNA, 22 bp, Artificial sequence
  SiRNA target sequence
attcggtggctagagtgcttaa

SEQ ID NO: 229847 - DNA, 22 bp, Artificial sequence
  SiRNA target sequence
ttcggtggctagagtgcttaaa

SEQ ID NO: 229848 - DNA, 22 bp, Artificial sequence
  SiRNA target sequence
tcggtggctagagtgcttaaag

SEQ ID NO: 229849 - DNA, 22 bp, Artificial sequence
  SiRNA target sequence
cggtggctagagtgcttaaaga

SEQ ID NO: 229850 - DNA, 22 bp, Artificial sequence
  SiRNA target sequence
ggtggctagagtgcttaaagat

SEQ ID NO: 229851 - DNA, 22 bp, Artificial sequence
  SiRNA target sequence
gtggctagagtgcttaaagatg

SEQ ID NO: 229852 - DNA, 22 bp, Artificial sequence
  SiRNA target sequence
tggctagagtgcttaaagatgc

SEQ ID NO: 229853 - DNA, 22 bp, Artificial sequence
  SiRNA target sequence
ggctagagtgcttaaagatgcc

SEQ ID NO: 229854 - DNA, 22 bp, Artificial sequence
  SiRNA target sequence
gctagagtgcttaaagatgccg

SEQ ID NO: 229855 - DNA, 22 bp, Artificial sequence
  SiRNA target sequence
ctagagtgcttaaagatgccgc

SEQ ID NO: 229856 - DNA, 22 bp, Artificial sequence
  SiRNA target sequence
tagagtgcttaaagatgccgct

SEQ ID NO: 229857 - DNA, 22 bp, Artificial sequence
  SiRNA target sequence
agagtgcttaaagatgccgctg

SEQ ID NO: 229858 - DNA, 22 bp, Artificial sequence
  SiRNA target sequence
gagtgcttaaagatgccgctgt

SEQ ID NO: 229859 - DNA, 22 bp, Artificial sequence
  SiRNA target sequence
agtgcttaaagatgccgctgtt

SEQ ID NO: 229860 - DNA, 22 bp, Artificial sequence
  SiRNA target sequence
gtgcttaaagatgccgctgtta

SEQ ID NO: 229861 - DNA, 22 bp, Artificial sequence
  SiRNA target sequence
tgcttaaagatgccgctgttat

SEQ ID NO: 229862 - DNA, 22 bp, Artificial sequence
  SiRNA target sequence
gcttaaagatgccgctgttatt

SEQ ID NO: 229863 - DNA, 22 bp, Artificial sequence
  SiRNA target sequence
cttaaagatgccgctgttattg

SEQ ID NO: 229864 - DNA, 22 bp, Artificial sequence
  SiRNA target sequence
ttaaagatgccgctgttattgg

SEQ ID NO: 229865 - DNA, 22 bp, Artificial sequence
  SiRNA target sequence
taaagatgccgctgttattggt

SEQ ID NO: 229866 - DNA, 22 bp, Artificial sequence
  SiRNA target sequence
aaagatgccgctgttattggta

SEQ ID NO: 229867 - DNA, 22 bp, Artificial sequence
  SiRNA target sequence
aagatgccgctgttattggtaa

SEQ ID NO: 229868 - DNA, 22 bp, Artificial sequence
  SiRNA target sequence
agatgccgctgttattggtaaa

SEQ ID NO: 229869 - DNA, 22 bp, Artificial sequence
  SiRNA target sequence
gatgccgctgttattggtaaac

SEQ ID NO: 229870 - DNA, 22 bp, Artificial sequence
  SiRNA target sequence
atgccgctgttattggtaaaca

SEQ ID NO: 229871 - DNA, 22 bp, Artificial sequence
  SiRNA target sequence
tgccgctgttattggtaaacaa

SEQ ID NO: 229872 - DNA, 22 bp, Artificial sequence
  SiRNA target sequence
gccgctgttattggtaaacaac

SEQ ID NO: 229873 - DNA, 22 bp, Artificial sequence
  SiRNA target sequence
ccgctgttattggtaaacaact

SEQ ID NO: 229874 - DNA, 22 bp, Artificial sequence
  SiRNA target sequence
cgctgttattggtaaacaactc

SEQ ID NO: 229875 - DNA, 22 bp, Artificial sequence
  SiRNA target sequence
gctgttattggtaaacaactcc

SEQ ID NO: 229876 - DNA, 22 bp, Artificial sequence
  SiRNA target sequence
ctgttattggtaaacaactccc

SEQ ID NO: 229877 - DNA, 22 bp, Artificial sequence
  SiRNA target sequence
tgttattggtaaacaactccca

SEQ ID NO: 229878 - DNA, 22 bp, Artificial sequence
  SiRNA target sequence
gttattggtaaacaactcccag

SEQ ID NO: 229879 - DNA, 22 bp, Artificial sequence
  SiRNA target sequence
ttattggtaaacaactcccagc

SEQ ID NO: 229880 - DNA, 22 bp, Artificial sequence
  SiRNA target sequence
tattggtaaacaactcccagcg

SEQ ID NO: 229881 - DNA, 22 bp, Artificial sequence
  SiRNA target sequence
attggtaaacaactcccagcgt

SEQ ID NO: 229882 - DNA, 22 bp, Artificial sequence
  SiRNA target sequence
ttggtaaacaactcccagcgtc

SEQ ID NO: 229883 - DNA, 22 bp, Artificial sequence
  SiRNA target sequence
tggtaaacaactcccagcgtca

SEQ ID NO: 229884 - DNA, 22 bp, Artificial sequence
  SiRNA target sequence
ggtaaacaactcccagcgtcaa

SEQ ID NO: 229885 - DNA, 22 bp, Artificial sequence
  SiRNA target sequence
gtaaacaactcccagcgtcaat

SEQ ID NO: 229886 - DNA, 22 bp, Artificial sequence
  SiRNA target sequence
taaacaactcccagcgtcaatt

SEQ ID NO: 229887 - DNA, 22 bp, Artificial sequence
  SiRNA target sequence
aaacaactcccagcgtcaattt

SEQ ID NO: 229888 - DNA, 22 bp, Artificial sequence
  SiRNA target sequence
aacaactcccagcgtcaatttt

SEQ ID NO: 229889 - DNA, 22 bp, Artificial sequence
  SiRNA target sequence
acaactcccagcgtcaattttc

SEQ ID NO: 229890 - DNA, 22 bp, Artificial sequence
  SiRNA target sequence
caactcccagcgtcaattttct

SEQ ID NO: 229891 - DNA, 22 bp, Artificial sequence
  SiRNA target sequence
aactcccagcgtcaattttctt

SEQ ID NO: 229892 - DNA, 22 bp, Artificial sequence
  SiRNA target sequence
actcccagcgtcaattttcttt

SEQ ID NO: 229893 - DNA, 22 bp, Artificial sequence
  SiRNA target sequence
ctcccagcgtcaattttctttt

SEQ ID NO: 229894 - DNA, 22 bp, Artificial sequence
  SiRNA target sequence
tcccagcgtcaattttcttttt

SEQ ID NO: 229895 - DNA, 22 bp, Artificial sequence
  SiRNA target sequence
cccagcgtcaattttctttttg

SEQ ID NO: 229896 - DNA, 22 bp, Artificial sequence
  SiRNA target sequence
ccagcgtcaattttctttttga

SEQ ID NO: 229897 - DNA, 22 bp, Artificial sequence
  SiRNA target sequence
cagcgtcaattttctttttgaa

SEQ ID NO: 229898 - DNA, 22 bp, Artificial sequence
  SiRNA target sequence
agcgtcaattttctttttgaaa

SEQ ID NO: 229899 - DNA, 22 bp, Artificial sequence
  SiRNA target sequence
gcgtcaattttctttttgaaat

SEQ ID NO: 229900 - DNA, 22 bp, Artificial sequence
  SiRNA target sequence
cgtcaattttctttttgaaatt

SEQ ID NO: 229901 - DNA, 22 bp, Artificial sequence
  SiRNA target sequence
gtcaattttctttttgaaattt

SEQ ID NO: 229902 - DNA, 22 bp, Artificial sequence
  SiRNA target sequence
tcaattttctttttgaaatttg

SEQ ID NO: 229903 - DNA, 22 bp, Artificial sequence
  SiRNA target sequence
caattttctttttgaaatttgt

SEQ ID NO: 229904 - DNA, 22 bp, Artificial sequence
  SiRNA target sequence
aattttctttttgaaatttgtt

SEQ ID NO: 229905 - DNA, 22 bp, Artificial sequence
  SiRNA target sequence
attttctttttgaaatttgtta

SEQ ID NO: 229906 - DNA, 22 bp, Artificial sequence
  SiRNA target sequence
ttttctttttgaaatttgttat

SEQ ID NO: 229907 - DNA, 22 bp, Artificial sequence
  SiRNA target sequence
tttctttttgaaatttgttatt

SEQ ID NO: 229908 - DNA, 22 bp, Artificial sequence
  SiRNA target sequence
ttctttttgaaatttgttatta

SEQ ID NO: 229909 - DNA, 22 bp, Artificial sequence
  SiRNA target sequence
tctttttgaaatttgttattat

SEQ ID NO: 229910 - DNA, 22 bp, Artificial sequence
  SiRNA target sequence
ctttttgaaatttgttattatc

SEQ ID NO: 229911 - DNA, 22 bp, Artificial sequence
  SiRNA target sequence
tttttgaaatttgttattatcc

SEQ ID NO: 229912 - DNA, 22 bp, Artificial sequence
  SiRNA target sequence
ttttgaaatttgttattatcct

SEQ ID NO: 229913 - DNA, 22 bp, Artificial sequence
  SiRNA target sequence
tttgaaatttgttattatcctt

SEQ ID NO: 229914 - DNA, 22 bp, Artificial sequence
  SiRNA target sequence
ttgaaatttgttattatccttc

SEQ ID NO: 229915 - DNA, 22 bp, Artificial sequence
  SiRNA target sequence
tgaaatttgttattatccttcc

SEQ ID NO: 229916 - DNA, 22 bp, Artificial sequence
  SiRNA target sequence
gaaatttgttattatccttccg

SEQ ID NO: 229917 - DNA, 22 bp, Artificial sequence
  SiRNA target sequence
aaatttgttattatccttccgt

SEQ ID NO: 229918 - DNA, 22 bp, Artificial sequence
  SiRNA target sequence
aatttgttattatccttccgtt

SEQ ID NO: 229919 - DNA, 22 bp, Artificial sequence
  SiRNA target sequence
atttgttattatccttccgttc

SEQ ID NO: 229920 - DNA, 22 bp, Artificial sequence
  SiRNA target sequence
tttgttattatccttccgttct

SEQ ID NO: 229921 - DNA, 22 bp, Artificial sequence
  SiRNA target sequence
ttgttattatccttccgttctc

SEQ ID NO: 229922 - DNA, 22 bp, Artificial sequence
  SiRNA target sequence
tgttattatccttccgttctca

SEQ ID NO: 229923 - DNA, 22 bp, Artificial sequence
  SiRNA target sequence
gttattatccttccgttctcat

SEQ ID NO: 229924 - DNA, 22 bp, Artificial sequence
  SiRNA target sequence
ttattatccttccgttctcatt

SEQ ID NO: 229925 - DNA, 22 bp, Artificial sequence
  SiRNA target sequence
tattatccttccgttctcattt

SEQ ID NO: 229926 - DNA, 22 bp, Artificial sequence
  SiRNA target sequence
attatccttccgttctcattta

SEQ ID NO: 229927 - DNA, 22 bp, Artificial sequence
  SiRNA target sequence
ttatccttccgttctcatttat

SEQ ID NO: 229928 - DNA, 22 bp, Artificial sequence
  SiRNA target sequence
tatccttccgttctcatttatt

SEQ ID NO: 229929 - DNA, 22 bp, Artificial sequence
  SiRNA target sequence
atccttccgttctcatttattt

SEQ ID NO: 229930 - DNA, 22 bp, Artificial sequence
  SiRNA target sequence
tccttccgttctcatttatttc

SEQ ID NO: 229931 - DNA, 22 bp, Artificial sequence
  SiRNA target sequence
ccttccgttctcatttatttca

SEQ ID NO: 229932 - DNA, 22 bp, Artificial sequence
  SiRNA target sequence
cttccgttctcatttatttcag

SEQ ID NO: 229933 - DNA, 22 bp, Artificial sequence
  SiRNA target sequence
ttccgttctcatttatttcagt

SEQ ID NO: 229934 - DNA, 22 bp, Artificial sequence
  SiRNA target sequence
tccgttctcatttatttcagta

SEQ ID NO: 229935 - DNA, 22 bp, Artificial sequence
  SiRNA target sequence
ccgttctcatttatttcagtag

SEQ ID NO: 229936 - DNA, 22 bp, Artificial sequence
  SiRNA target sequence
cgttctcatttatttcagtagg

SEQ ID NO: 229937 - DNA, 22 bp, Artificial sequence
  SiRNA target sequence
gttctcatttatttcagtaggt

SEQ ID NO: 229938 - DNA, 22 bp, Artificial sequence
  SiRNA target sequence
ttctcatttatttcagtaggta

SEQ ID NO: 229939 - DNA, 22 bp, Artificial sequence
  SiRNA target sequence
tctcatttatttcagtaggtat

SEQ ID NO: 229940 - DNA, 22 bp, Artificial sequence
  SiRNA target sequence
ctcatttatttcagtaggtatt

SEQ ID NO: 229941 - DNA, 22 bp, Artificial sequence
  SiRNA target sequence
tcatttatttcagtaggtatta

SEQ ID NO: 229942 - DNA, 22 bp, Artificial sequence
  SiRNA target sequence
catttatttcagtaggtattat

SEQ ID NO: 229943 - DNA, 22 bp, Artificial sequence
  SiRNA target sequence
atttatttcagtaggtattatt

SEQ ID NO: 229944 - DNA, 22 bp, Artificial sequence
  SiRNA target sequence
tttatttcagtaggtattattc

SEQ ID NO: 229945 - DNA, 22 bp, Artificial sequence
  SiRNA target sequence
ttatttcagtaggtattattca

SEQ ID NO: 229946 - DNA, 22 bp, Artificial sequence
  SiRNA target sequence
tatttcagtaggtattattcag

SEQ ID NO: 229947 - DNA, 22 bp, Artificial sequence
  SiRNA target sequence
atttcagtaggtattattcaga

SEQ ID NO: 229948 - DNA, 22 bp, Artificial sequence
  SiRNA target sequence
tttcagtaggtattattcagaa

SEQ ID NO: 229949 - DNA, 22 bp, Artificial sequence
  SiRNA target sequence
ttcagtaggtattattcagaaa

SEQ ID NO: 229950 - DNA, 22 bp, Artificial sequence
  SiRNA target sequence
tcagtaggtattattcagaaag

SEQ ID NO: 229951 - DNA, 22 bp, Artificial sequence
  SiRNA target sequence
cagtaggtattattcagaaagc

SEQ ID NO: 229952 - DNA, 22 bp, Artificial sequence
  SiRNA target sequence
agtaggtattattcagaaagct

SEQ ID NO: 229953 - DNA, 22 bp, Artificial sequence
  SiRNA target sequence
gtaggtattattcagaaagctt

SEQ ID NO: 229954 - DNA, 22 bp, Artificial sequence
  SiRNA target sequence
taggtattattcagaaagcttt

SEQ ID NO: 229955 - DNA, 22 bp, Artificial sequence
  SiRNA target sequence
aggtattattcagaaagcttta

SEQ ID NO: 229956 - DNA, 22 bp, Artificial sequence
  SiRNA target sequence
ggtattattcagaaagctttag

SEQ ID NO: 229957 - DNA, 22 bp, Artificial sequence
  SiRNA target sequence
gtattattcagaaagctttaga

SEQ ID NO: 229958 - DNA, 22 bp, Artificial sequence
  SiRNA target sequence
tattattcagaaagctttagat

SEQ ID NO: 229959 - DNA, 22 bp, Artificial sequence
  SiRNA target sequence
attattcagaaagctttagata

SEQ ID NO: 229960 - DNA, 22 bp, Artificial sequence
  SiRNA target sequence
ttattcagaaagctttagataa

SEQ ID NO: 229961 - DNA, 22 bp, Artificial sequence
  SiRNA target sequence
tattcagaaagctttagataaa

SEQ ID NO: 229962 - DNA, 22 bp, Artificial sequence
  SiRNA target sequence
attcagaaagctttagataaat

SEQ ID NO: 229963 - DNA, 22 bp, Artificial sequence
  SiRNA target sequence
ttcagaaagctttagataaata

SEQ ID NO: 229964 - DNA, 22 bp, Artificial sequence
  SiRNA target sequence
tcagaaagctttagataaatat

SEQ ID NO: 229965 - DNA, 22 bp, Artificial sequence
  SiRNA target sequence
cagaaagctttagataaatatc

SEQ ID NO: 229966 - DNA, 22 bp, Artificial sequence
  SiRNA target sequence
agaaagctttagataaatatcc

SEQ ID NO: 229967 - DNA, 22 bp, Artificial sequence
  SiRNA target sequence
gaaagctttagataaatatcct

SEQ ID NO: 229968 - DNA, 22 bp, Artificial sequence
  SiRNA target sequence
aaagctttagataaatatcctt

SEQ ID NO: 229969 - DNA, 22 bp, Artificial sequence
  SiRNA target sequence
aagctttagataaatatccttt

SEQ ID NO: 229970 - DNA, 22 bp, Artificial sequence
  SiRNA target sequence
agctttagataaatatcctttt

SEQ ID NO: 229971 - DNA, 22 bp, Artificial sequence
  SiRNA target sequence
gctttagataaatatcctttta

SEQ ID NO: 229972 - DNA, 22 bp, Artificial sequence
  SiRNA target sequence
ctttagataaatatccttttac

SEQ ID NO: 229973 - DNA, 22 bp, Artificial sequence
  SiRNA target sequence
tttagataaatatccttttaca

SEQ ID NO: 229974 - DNA, 22 bp, Artificial sequence
  SiRNA target sequence
ttagataaatatccttttacaa

SEQ ID NO: 229975 - DNA, 22 bp, Artificial sequence
  SiRNA target sequence
tagataaatatccttttacaaa

SEQ ID NO: 229976 - DNA, 22 bp, Artificial sequence
  SiRNA target sequence
agataaatatccttttacaaaa

SEQ ID NO: 229977 - DNA, 22 bp, Artificial sequence
  SiRNA target sequence
gataaatatccttttacaaaaa

SEQ ID NO: 229978 - DNA, 22 bp, Artificial sequence
  SiRNA target sequence
ataaatatccttttacaaaaat

SEQ ID NO: 229979 - DNA, 22 bp, Artificial sequence
  SiRNA target sequence
taaatatccttttacaaaaata

SEQ ID NO: 229980 - DNA, 22 bp, Artificial sequence
  SiRNA target sequence
aaatatccttttacaaaaatat

SEQ ID NO: 229981 - DNA, 22 bp, Artificial sequence
  SiRNA target sequence
aatatccttttacaaaaatatt

SEQ ID NO: 229982 - DNA, 22 bp, Artificial sequence
  SiRNA target sequence
atatccttttacaaaaatattt

SEQ ID NO: 229983 - DNA, 22 bp, Artificial sequence
  SiRNA target sequence
tatccttttacaaaaatatttg

SEQ ID NO: 229984 - DNA, 22 bp, Artificial sequence
  SiRNA target sequence
atccttttacaaaaatatttga

SEQ ID NO: 229985 - DNA, 22 bp, Artificial sequence
  SiRNA target sequence
tccttttacaaaaatatttgat

SEQ ID NO: 229986 - DNA, 22 bp, Artificial sequence
  SiRNA target sequence
ccttttacaaaaatatttgatg

SEQ ID NO: 229987 - DNA, 22 bp, Artificial sequence
  SiRNA target sequence
cttttacaaaaatatttgatgt

SEQ ID NO: 229988 - DNA, 22 bp, Artificial sequence
  SiRNA target sequence
ttttacaaaaatatttgatgta

SEQ ID NO: 229989 - DNA, 22 bp, Artificial sequence
  SiRNA target sequence
tttacaaaaatatttgatgtaa

SEQ ID NO: 229990 - DNA, 22 bp, Artificial sequence
  SiRNA target sequence
ttacaaaaatatttgatgtaac

SEQ ID NO: 229991 - DNA, 22 bp, Artificial sequence
  SiRNA target sequence
tacaaaaatatttgatgtaact

SEQ ID NO: 229992 - DNA, 22 bp, Artificial sequence
  SiRNA target sequence
acaaaaatatttgatgtaactt

SEQ ID NO: 229993 - DNA, 22 bp, Artificial sequence
  SiRNA target sequence
caaaaatatttgatgtaacttt

SEQ ID NO: 229994 - DNA, 22 bp, Artificial sequence
  SiRNA target sequence
aaaaatatttgatgtaacttta

SEQ ID NO: 229995 - DNA, 22 bp, Artificial sequence
  SiRNA target sequence
aaaatatttgatgtaactttaa

SEQ ID NO: 229996 - DNA, 22 bp, Artificial sequence
  SiRNA target sequence
aaatatttgatgtaactttaat

SEQ ID NO: 229997 - DNA, 22 bp, Artificial sequence
  SiRNA target sequence
aatatttgatgtaactttaata

SEQ ID NO: 229998 - DNA, 22 bp, Artificial sequence
  SiRNA target sequence
atatttgatgtaactttaatag

SEQ ID NO: 229999 - DNA, 22 bp, Artificial sequence
  SiRNA target sequence
tatttgatgtaactttaatagt

SEQ ID NO: 230000 - DNA, 22 bp, Artificial sequence
  SiRNA target sequence
atttgatgtaactttaatagtt

SEQ ID NO: 230001 - DNA, 22 bp, Artificial sequence
  SiRNA target sequence
tttgatgtaactttaatagttt

SEQ ID NO: 230002 - DNA, 22 bp, Artificial sequence
  SiRNA target sequence
ttgatgtaactttaatagtttt

SEQ ID NO: 230003 - DNA, 22 bp, Artificial sequence
  SiRNA target sequence
tgatgtaactttaatagttttc

SEQ ID NO: 230004 - DNA, 22 bp, Artificial sequence
  SiRNA target sequence
gatgtaactttaatagttttcg

SEQ ID NO: 230005 - DNA, 22 bp, Artificial sequence
  SiRNA target sequence
atgtaactttaatagttttcgc

SEQ ID NO: 230006 - DNA, 22 bp, Artificial sequence
  SiRNA target sequence
tgtaactttaatagttttcgct

SEQ ID NO: 230007 - DNA, 22 bp, Artificial sequence
  SiRNA target sequence
gtaactttaatagttttcgctg

SEQ ID NO: 230008 - DNA, 22 bp, Artificial sequence
  SiRNA target sequence
taactttaatagttttcgctgt

SEQ ID NO: 230009 - DNA, 22 bp, Artificial sequence
  SiRNA target sequence
aactttaatagttttcgctgtt

SEQ ID NO: 230010 - DNA, 22 bp, Artificial sequence
  SiRNA target sequence
actttaatagttttcgctgttg

SEQ ID NO: 230011 - DNA, 22 bp, Artificial sequence
  SiRNA target sequence
ctttaatagttttcgctgttgc

SEQ ID NO: 230012 - DNA, 22 bp, Artificial sequence
  SiRNA target sequence
tttaatagttttcgctgttgca

SEQ ID NO: 230013 - DNA, 22 bp, Artificial sequence
  SiRNA target sequence
ttaatagttttcgctgttgcat

SEQ ID NO: 230014 - DNA, 22 bp, Artificial sequence
  SiRNA target sequence
taatagttttcgctgttgcatt

SEQ ID NO: 230015 - DNA, 22 bp, Artificial sequence
  SiRNA target sequence
aatagttttcgctgttgcattt

SEQ ID NO: 230016 - DNA, 22 bp, Artificial sequence
  SiRNA target sequence
atagttttcgctgttgcattta

SEQ ID NO: 230017 - DNA, 22 bp, Artificial sequence
  SiRNA target sequence
tagttttcgctgttgcatttac

SEQ ID NO: 230018 - DNA, 22 bp, Artificial sequence
  SiRNA target sequence
agttttcgctgttgcatttact

SEQ ID NO: 230019 - DNA, 22 bp, Artificial sequence
  SiRNA target sequence
gttttcgctgttgcatttacta

SEQ ID NO: 230020 - DNA, 22 bp, Artificial sequence
  SiRNA target sequence
ttttcgctgttgcatttactat

SEQ ID NO: 230021 - DNA, 22 bp, Artificial sequence
  SiRNA target sequence
tttcgctgttgcatttactata

SEQ ID NO: 230022 - DNA, 22 bp, Artificial sequence
  SiRNA target sequence
ttcgctgttgcatttactatac

SEQ ID NO: 230023 - DNA, 22 bp, Artificial sequence
  SiRNA target sequence
tcgctgttgcatttactatact

SEQ ID NO: 230024 - DNA, 22 bp, Artificial sequence
  SiRNA target sequence
cgctgttgcatttactatactt

SEQ ID NO: 230025 - DNA, 22 bp, Artificial sequence
  SiRNA target sequence
gctgttgcatttactatacttg

SEQ ID NO: 230026 - DNA, 22 bp, Artificial sequence
  SiRNA target sequence
ctgttgcatttactatacttgg

SEQ ID NO: 230027 - DNA, 22 bp, Artificial sequence
  SiRNA target sequence
tgttgcatttactatacttggt

SEQ ID NO: 230028 - DNA, 22 bp, Artificial sequence
  SiRNA target sequence
gttgcatttactatacttggta

SEQ ID NO: 230029 - DNA, 22 bp, Artificial sequence
  SiRNA target sequence
ttgcatttactatacttggtag

SEQ ID NO: 230030 - DNA, 22 bp, Artificial sequence
  SiRNA target sequence
tgcatttactatacttggtagt

SEQ ID NO: 230031 - DNA, 22 bp, Artificial sequence
  SiRNA target sequence
gcatttactatacttggtagtt

SEQ ID NO: 230032 - DNA, 22 bp, Artificial sequence
  SiRNA target sequence
catttactatacttggtagttt

SEQ ID NO: 230033 - DNA, 22 bp, Artificial sequence
  SiRNA target sequence
atttactatacttggtagttta

SEQ ID NO: 230034 - DNA, 22 bp, Artificial sequence
  SiRNA target sequence
tttactatacttggtagtttat

SEQ ID NO: 230035 - DNA, 22 bp, Artificial sequence
  SiRNA target sequence
ttactatacttggtagtttatt

SEQ ID NO: 230036 - DNA, 22 bp, Artificial sequence
  SiRNA target sequence
tactatacttggtagtttatta

SEQ ID NO: 230037 - DNA, 22 bp, Artificial sequence
  SiRNA target sequence
actatacttggtagtttattac

SEQ ID NO: 230038 - DNA, 22 bp, Artificial sequence
  SiRNA target sequence
ctatacttggtagtttattact

SEQ ID NO: 230039 - DNA, 22 bp, Artificial sequence
  SiRNA target sequence
tatacttggtagtttattactt

SEQ ID NO: 230040 - DNA, 22 bp, Artificial sequence
  SiRNA target sequence
atacttggtagtttattacttc

SEQ ID NO: 230041 - DNA, 22 bp, Artificial sequence
  SiRNA target sequence
tacttggtagtttattacttcc

SEQ ID NO: 230042 - DNA, 22 bp, Artificial sequence
  SiRNA target sequence
acttggtagtttattacttccc

SEQ ID NO: 230043 - DNA, 22 bp, Artificial sequence
  SiRNA target sequence
cttggtagtttattacttccct

SEQ ID NO: 230044 - DNA, 22 bp, Artificial sequence
  SiRNA target sequence
ttggtagtttattacttccctt

SEQ ID NO: 230045 - DNA, 22 bp, Artificial sequence
  SiRNA target sequence
tggtagtttattacttcccttt

SEQ ID NO: 230046 - DNA, 22 bp, Artificial sequence
  SiRNA target sequence
ggtagtttattacttcccttta

SEQ ID NO: 230047 - DNA, 22 bp, Artificial sequence
  SiRNA target sequence
gtagtttattacttccctttag

SEQ ID NO: 230048 - DNA, 22 bp, Artificial sequence
  SiRNA target sequence
tagtttattacttccctttagt

SEQ ID NO: 230049 - DNA, 22 bp, Artificial sequence
  SiRNA target sequence
agtttattacttccctttagtg

SEQ ID NO: 230050 - DNA, 22 bp, Artificial sequence
  SiRNA target sequence
gtttattacttccctttagtga

SEQ ID NO: 230051 - DNA, 22 bp, Artificial sequence
  SiRNA target sequence
tttattacttccctttagtgat

SEQ ID NO: 230052 - DNA, 22 bp, Artificial sequence
  SiRNA target sequence
ttattacttccctttagtgatt

SEQ ID NO: 230053 - DNA, 22 bp, Artificial sequence
  SiRNA target sequence
tattacttccctttagtgatta

SEQ ID NO: 230054 - DNA, 22 bp, Artificial sequence
  SiRNA target sequence
attacttccctttagtgattat

SEQ ID NO: 230055 - DNA, 22 bp, Artificial sequence
  SiRNA target sequence
ttacttccctttagtgattata

SEQ ID NO: 230056 - DNA, 22 bp, Artificial sequence
  SiRNA target sequence
tacttccctttagtgattatat

SEQ ID NO: 230057 - DNA, 22 bp, Artificial sequence
  SiRNA target sequence
acttccctttagtgattatatt

SEQ ID NO: 230058 - DNA, 22 bp, Artificial sequence
  SiRNA target sequence
cttccctttagtgattatattc

SEQ ID NO: 230059 - DNA, 22 bp, Artificial sequence
  SiRNA target sequence
ttccctttagtgattatattca

SEQ ID NO: 230060 - DNA, 22 bp, Artificial sequence
  SiRNA target sequence
tccctttagtgattatattcag

SEQ ID NO: 230061 - DNA, 22 bp, Artificial sequence
  SiRNA target sequence
ccctttagtgattatattcaga

SEQ ID NO: 230062 - DNA, 22 bp, Artificial sequence
  SiRNA target sequence
cctttagtgattatattcagat

SEQ ID NO: 230063 - DNA, 22 bp, Artificial sequence
  SiRNA target sequence
ctttagtgattatattcagatt

SEQ ID NO: 230064 - DNA, 22 bp, Artificial sequence
  SiRNA target sequence
tttagtgattatattcagattc

SEQ ID NO: 230065 - DNA, 22 bp, Artificial sequence
  SiRNA target sequence
ttagtgattatattcagattca

SEQ ID NO: 230066 - DNA, 22 bp, Artificial sequence
  SiRNA target sequence
tagtgattatattcagattcaa

SEQ ID NO: 230067 - DNA, 22 bp, Artificial sequence
  SiRNA target sequence
agtgattatattcagattcaac

SEQ ID NO: 230068 - DNA, 22 bp, Artificial sequence
  SiRNA target sequence
gtgattatattcagattcaacc

SEQ ID NO: 230069 - DNA, 22 bp, Artificial sequence
  SiRNA target sequence
tgattatattcagattcaaccg

SEQ ID NO: 230070 - DNA, 22 bp, Artificial sequence
  SiRNA target sequence
gattatattcagattcaaccgt

SEQ ID NO: 230071 - DNA, 22 bp, Artificial sequence
  SiRNA target sequence
attatattcagattcaaccgtt

SEQ ID NO: 230072 - DNA, 22 bp, Artificial sequence
  SiRNA target sequence
ttatattcagattcaaccgttt

SEQ ID NO: 230073 - DNA, 22 bp, Artificial sequence
  SiRNA target sequence
tatattcagattcaaccgtttt

SEQ ID NO: 230074 - DNA, 22 bp, Artificial sequence
  SiRNA target sequence
atattcagattcaaccgttttg

SEQ ID NO: 230075 - DNA, 22 bp, Artificial sequence
  SiRNA target sequence
tattcagattcaaccgttttgg

SEQ ID NO: 230076 - DNA, 22 bp, Artificial sequence
  SiRNA target sequence
attcagattcaaccgttttggg

SEQ ID NO: 230077 - DNA, 22 bp, Artificial sequence
  SiRNA target sequence
ttcagattcaaccgttttgggc

SEQ ID NO: 230078 - DNA, 22 bp, Artificial sequence
  SiRNA target sequence
tcagattcaaccgttttgggcc

SEQ ID NO: 230079 - DNA, 22 bp, Artificial sequence
  SiRNA target sequence
cagattcaaccgttttgggcca

SEQ ID NO: 230080 - DNA, 22 bp, Artificial sequence
  SiRNA target sequence
agattcaaccgttttgggccaa

SEQ ID NO: 230081 - DNA, 22 bp, Artificial sequence
  SiRNA target sequence
gattcaaccgttttgggccaaa

SEQ ID NO: 230082 - DNA, 22 bp, Artificial sequence
  SiRNA target sequence
attcaaccgttttgggccaaag

SEQ ID NO: 230083 - DNA, 22 bp, Artificial sequence
  SiRNA target sequence
ttcaaccgttttgggccaaaga

SEQ ID NO: 230084 - DNA, 22 bp, Artificial sequence
  SiRNA target sequence
tcaaccgttttgggccaaagat

SEQ ID NO: 230085 - DNA, 22 bp, Artificial sequence
  SiRNA target sequence
caaccgttttgggccaaagata

SEQ ID NO: 230086 - DNA, 22 bp, Artificial sequence
  SiRNA target sequence
aaccgttttgggccaaagatat

SEQ ID NO: 230087 - DNA, 22 bp, Artificial sequence
  SiRNA target sequence
accgttttgggccaaagatatt

SEQ ID NO: 230088 - DNA, 22 bp, Artificial sequence
  SiRNA target sequence
ccgttttgggccaaagatattt

SEQ ID NO: 230089 - DNA, 22 bp, Artificial sequence
  SiRNA target sequence
cgttttgggccaaagatatttt

SEQ ID NO: 230090 - DNA, 22 bp, Artificial sequence
  SiRNA target sequence
gttttgggccaaagatattttt

SEQ ID NO: 230091 - DNA, 22 bp, Artificial sequence
  SiRNA target sequence
ttttgggccaaagatatttttg

SEQ ID NO: 230092 - DNA, 22 bp, Artificial sequence
  SiRNA target sequence
tttgggccaaagatatttttgc

SEQ ID NO: 230093 - DNA, 22 bp, Artificial sequence
  SiRNA target sequence
ttgggccaaagatatttttgct

SEQ ID NO: 230094 - DNA, 22 bp, Artificial sequence
  SiRNA target sequence
tgggccaaagatatttttgctg

SEQ ID NO: 230095 - DNA, 22 bp, Artificial sequence
  SiRNA target sequence
gggccaaagatatttttgctga

SEQ ID NO: 230096 - DNA, 22 bp, Artificial sequence
  SiRNA target sequence
ggccaaagatatttttgctgat

SEQ ID NO: 230097 - DNA, 22 bp, Artificial sequence
  SiRNA target sequence
gccaaagatatttttgctgatg

SEQ ID NO: 230098 - DNA, 22 bp, Artificial sequence
  SiRNA target sequence
ccaaagatatttttgctgatgg

SEQ ID NO: 230099 - DNA, 22 bp, Artificial sequence
  SiRNA target sequence
caaagatatttttgctgatgga

SEQ ID NO: 230100 - DNA, 22 bp, Artificial sequence
  SiRNA target sequence
aaagatatttttgctgatggaa

SEQ ID NO: 230101 - DNA, 22 bp, Artificial sequence
  SiRNA target sequence
aagatatttttgctgatggaaa

SEQ ID NO: 230102 - DNA, 22 bp, Artificial sequence
  SiRNA target sequence
agatatttttgctgatggaaaa

SEQ ID NO: 230103 - DNA, 22 bp, Artificial sequence
  SiRNA target sequence
gatatttttgctgatggaaaag

SEQ ID NO: 230104 - DNA, 22 bp, Artificial sequence
  SiRNA target sequence
atatttttgctgatggaaaagc

SEQ ID NO: 230105 - DNA, 22 bp, Artificial sequence
  SiRNA target sequence
tatttttgctgatggaaaagct

SEQ ID NO: 230106 - DNA, 22 bp, Artificial sequence
  SiRNA target sequence
atttttgctgatggaaaagctg

SEQ ID NO: 230107 - DNA, 22 bp, Artificial sequence
  SiRNA target sequence
tttttgctgatggaaaagctgt

SEQ ID NO: 230108 - DNA, 22 bp, Artificial sequence
  SiRNA target sequence
ttttgctgatggaaaagctgtt

SEQ ID NO: 230109 - DNA, 22 bp, Artificial sequence
  SiRNA target sequence
tttgctgatggaaaagctgttg

SEQ ID NO: 230110 - DNA, 22 bp, Artificial sequence
  SiRNA target sequence
ttgctgatggaaaagctgttgc

SEQ ID NO: 230111 - DNA, 22 bp, Artificial sequence
  SiRNA target sequence
tgctgatggaaaagctgttgcc

SEQ ID NO: 230112 - DNA, 22 bp, Artificial sequence
  SiRNA target sequence
gctgatggaaaagctgttgcca

SEQ ID NO: 230113 - DNA, 22 bp, Artificial sequence
  SiRNA target sequence
ctgatggaaaagctgttgccag

SEQ ID NO: 230114 - DNA, 22 bp, Artificial sequence
  SiRNA target sequence
tgatggaaaagctgttgccaga

SEQ ID NO: 230115 - DNA, 22 bp, Artificial sequence
  SiRNA target sequence
gatggaaaagctgttgccagaa

SEQ ID NO: 230116 - DNA, 22 bp, Artificial sequence
  SiRNA target sequence
atggaaaagctgttgccagaag

SEQ ID NO: 230117 - DNA, 22 bp, Artificial sequence
  SiRNA target sequence
tggaaaagctgttgccagaagt

SEQ ID NO: 230118 - DNA, 22 bp, Artificial sequence
  SiRNA target sequence
ggaaaagctgttgccagaagta

SEQ ID NO: 230119 - DNA, 22 bp, Artificial sequence
  SiRNA target sequence
gaaaagctgttgccagaagtac

SEQ ID NO: 230120 - DNA, 22 bp, Artificial sequence
  SiRNA target sequence
aaaagctgttgccagaagtaca

SEQ ID NO: 230121 - DNA, 22 bp, Artificial sequence
  SiRNA target sequence
aaagctgttgccagaagtacag

SEQ ID NO: 230122 - DNA, 22 bp, Artificial sequence
  SiRNA target sequence
aagctgttgccagaagtacaga

SEQ ID NO: 230123 - DNA, 22 bp, Artificial sequence
  SiRNA target sequence
agctgttgccagaagtacagat

SEQ ID NO: 230124 - DNA, 22 bp, Artificial sequence
  SiRNA target sequence
gctgttgccagaagtacagatt

SEQ ID NO: 230125 - DNA, 22 bp, Artificial sequence
  SiRNA target sequence
ctgttgccagaagtacagattt

SEQ ID NO: 230126 - DNA, 22 bp, Artificial sequence
  SiRNA target sequence
tgttgccagaagtacagatttt

SEQ ID NO: 230127 - DNA, 22 bp, Artificial sequence
  SiRNA target sequence
gttgccagaagtacagattttt

SEQ ID NO: 230128 - DNA, 22 bp, Artificial sequence
  SiRNA target sequence
ttgccagaagtacagatttttt

SEQ ID NO: 230129 - DNA, 22 bp, Artificial sequence
  SiRNA target sequence
tgccagaagtacagatttttta

SEQ ID NO: 230130 - DNA, 22 bp, Artificial sequence
  SiRNA target sequence
gccagaagtacagattttttat

SEQ ID NO: 230131 - DNA, 22 bp, Artificial sequence
  SiRNA target sequence
ccagaagtacagattttttatt

SEQ ID NO: 230132 - DNA, 22 bp, Artificial sequence
  SiRNA target sequence
cagaagtacagattttttattt

SEQ ID NO: 230133 - DNA, 22 bp, Artificial sequence
  SiRNA target sequence
agaagtacagattttttatttt

SEQ ID NO: 230134 - DNA, 22 bp, Artificial sequence
  SiRNA target sequence
gaagtacagattttttattttc

SEQ ID NO: 230135 - DNA, 22 bp, Artificial sequence
  SiRNA target sequence
aagtacagattttttattttct

SEQ ID NO: 230136 - DNA, 22 bp, Artificial sequence
  SiRNA target sequence
agtacagattttttattttcta

SEQ ID NO: 230137 - DNA, 22 bp, Artificial sequence
  SiRNA target sequence
gtacagattttttattttctat

SEQ ID NO: 230138 - DNA, 22 bp, Artificial sequence
  SiRNA target sequence
tacagattttttattttctatt

SEQ ID NO: 230139 - DNA, 22 bp, Artificial sequence
  SiRNA target sequence
acagattttttattttctattg

SEQ ID NO: 230140 - DNA, 22 bp, Artificial sequence
  SiRNA target sequence
cagattttttattttctattgc

SEQ ID NO: 230141 - DNA, 22 bp, Artificial sequence
  SiRNA target sequence
agattttttattttctattgca

SEQ ID NO: 230142 - DNA, 22 bp, Artificial sequence
  SiRNA target sequence
gattttttattttctattgcac

SEQ ID NO: 230143 - DNA, 22 bp, Artificial sequence
  SiRNA target sequence
attttttattttctattgcact

SEQ ID NO: 230144 - DNA, 22 bp, Artificial sequence
  SiRNA target sequence
ttttttattttctattgcactt

SEQ ID NO: 230145 - DNA, 22 bp, Artificial sequence
  SiRNA target sequence
tttttattttctattgcacttg

SEQ ID NO: 230146 - DNA, 22 bp, Artificial sequence
  SiRNA target sequence
ttttattttctattgcacttgt

SEQ ID NO: 230147 - DNA, 22 bp, Artificial sequence
  SiRNA target sequence
tttattttctattgcacttgtt

SEQ ID NO: 230148 - DNA, 22 bp, Artificial sequence
  SiRNA target sequence
ttattttctattgcacttgttt

SEQ ID NO: 230149 - DNA, 22 bp, Artificial sequence
  SiRNA target sequence
tattttctattgcacttgtttt

SEQ ID NO: 230150 - DNA, 22 bp, Artificial sequence
  SiRNA target sequence
attttctattgcacttgttttc

SEQ ID NO: 230151 - DNA, 22 bp, Artificial sequence
  SiRNA target sequence
ttttctattgcacttgttttca

SEQ ID NO: 230152 - DNA, 22 bp, Artificial sequence
  SiRNA target sequence
tttctattgcacttgttttcaa

SEQ ID NO: 230153 - DNA, 22 bp, Artificial sequence
  SiRNA target sequence
ttctattgcacttgttttcaat

SEQ ID NO: 230154 - DNA, 22 bp, Artificial sequence
  SiRNA target sequence
tctattgcacttgttttcaatg

SEQ ID NO: 230155 - DNA, 22 bp, Artificial sequence
  SiRNA target sequence
ctattgcacttgttttcaatga

SEQ ID NO: 230156 - DNA, 22 bp, Artificial sequence
  SiRNA target sequence
tattgcacttgttttcaatgaa

SEQ ID NO: 230157 - DNA, 22 bp, Artificial sequence
  SiRNA target sequence
attgcacttgttttcaatgaat

SEQ ID NO: 230158 - DNA, 22 bp, Artificial sequence
  SiRNA target sequence
ttgcacttgttttcaatgaatg

SEQ ID NO: 230159 - DNA, 22 bp, Artificial sequence
  SiRNA target sequence
tgcacttgttttcaatgaatgg

SEQ ID NO: 230160 - DNA, 22 bp, Artificial sequence
  SiRNA target sequence
gcacttgttttcaatgaatgga

SEQ ID NO: 230161 - DNA, 22 bp, Artificial sequence
  SiRNA target sequence
cacttgttttcaatgaatggac

SEQ ID NO: 230162 - DNA, 22 bp, Artificial sequence
  SiRNA target sequence
acttgttttcaatgaatggaca

SEQ ID NO: 230163 - DNA, 22 bp, Artificial sequence
  SiRNA target sequence
cttgttttcaatgaatggacaa

SEQ ID NO: 230164 - DNA, 22 bp, Artificial sequence
  SiRNA target sequence
ttgttttcaatgaatggacaag

SEQ ID NO: 230165 - DNA, 22 bp, Artificial sequence
  SiRNA target sequence
tgttttcaatgaatggacaagt

SEQ ID NO: 230166 - DNA, 22 bp, Artificial sequence
  SiRNA target sequence
gttttcaatgaatggacaagtt

SEQ ID NO: 230167 - DNA, 22 bp, Artificial sequence
  SiRNA target sequence
ttttcaatgaatggacaagttc

SEQ ID NO: 230168 - DNA, 22 bp, Artificial sequence
  SiRNA target sequence
tttcaatgaatggacaagttct

SEQ ID NO: 230169 - DNA, 22 bp, Artificial sequence
  SiRNA target sequence
ttcaatgaatggacaagttctg

SEQ ID NO: 230170 - DNA, 22 bp, Artificial sequence
  SiRNA target sequence
tcaatgaatggacaagttctgc

SEQ ID NO: 230171 - DNA, 22 bp, Artificial sequence
  SiRNA target sequence
caatgaatggacaagttctgct

SEQ ID NO: 230172 - DNA, 22 bp, Artificial sequence
  SiRNA target sequence
aatgaatggacaagttctgcta

SEQ ID NO: 230173 - DNA, 22 bp, Artificial sequence
  SiRNA target sequence
atgaatggacaagttctgctat

SEQ ID NO: 230174 - DNA, 22 bp, Artificial sequence
  SiRNA target sequence
tgaatggacaagttctgctatc

SEQ ID NO: 230175 - DNA, 22 bp, Artificial sequence
  SiRNA target sequence
gaatggacaagttctgctatct

SEQ ID NO: 230176 - DNA, 22 bp, Artificial sequence
  SiRNA target sequence
aatggacaagttctgctatcta

SEQ ID NO: 230177 - DNA, 22 bp, Artificial sequence
  SiRNA target sequence
atggacaagttctgctatctat

SEQ ID NO: 230178 - DNA, 22 bp, Artificial sequence
  SiRNA target sequence
tggacaagttctgctatctatg

SEQ ID NO: 230179 - DNA, 22 bp, Artificial sequence
  SiRNA target sequence
ggacaagttctgctatctatgt

SEQ ID NO: 230180 - DNA, 22 bp, Artificial sequence
  SiRNA target sequence
gacaagttctgctatctatgtt

SEQ ID NO: 230181 - DNA, 22 bp, Artificial sequence
  SiRNA target sequence
acaagttctgctatctatgttt

SEQ ID NO: 230182 - DNA, 22 bp, Artificial sequence
  SiRNA target sequence
caagttctgctatctatgtttt

SEQ ID NO: 230183 - DNA, 22 bp, Artificial sequence
  SiRNA target sequence
aagttctgctatctatgtttta

SEQ ID NO: 230184 - DNA, 22 bp, Artificial sequence
  SiRNA target sequence
agttctgctatctatgttttat

SEQ ID NO: 230185 - DNA, 22 bp, Artificial sequence
  SiRNA target sequence
gttctgctatctatgttttatc

SEQ ID NO: 230186 - DNA, 22 bp, Artificial sequence
  SiRNA target sequence
ttctgctatctatgttttatct

SEQ ID NO: 230187 - DNA, 22 bp, Artificial sequence
  SiRNA target sequence
tctgctatctatgttttatctg

SEQ ID NO: 230188 - DNA, 22 bp, Artificial sequence
  SiRNA target sequence
ctgctatctatgttttatctga

SEQ ID NO: 230189 - DNA, 22 bp, Artificial sequence
  SiRNA target sequence
tgctatctatgttttatctgaa

SEQ ID NO: 230190 - DNA, 22 bp, Artificial sequence
  SiRNA target sequence
gctatctatgttttatctgaaa

SEQ ID NO: 230191 - DNA, 22 bp, Artificial sequence
  SiRNA target sequence
ctatctatgttttatctgaaat

SEQ ID NO: 230192 - DNA, 22 bp, Artificial sequence
  SiRNA target sequence
tatctatgttttatctgaaatg

SEQ ID NO: 230193 - DNA, 22 bp, Artificial sequence
  SiRNA target sequence
atctatgttttatctgaaatgt

SEQ ID NO: 230194 - DNA, 22 bp, Artificial sequence
  SiRNA target sequence
tctatgttttatctgaaatgtt

SEQ ID NO: 230195 - DNA, 22 bp, Artificial sequence
  SiRNA target sequence
ctatgttttatctgaaatgttt

SEQ ID NO: 230196 - DNA, 22 bp, Artificial sequence
  SiRNA target sequence
tatgttttatctgaaatgtttg

SEQ ID NO: 230197 - DNA, 22 bp, Artificial sequence
  SiRNA target sequence
atgttttatctgaaatgtttgg

SEQ ID NO: 230198 - DNA, 22 bp, Artificial sequence
  SiRNA target sequence
tgttttatctgaaatgtttggt

SEQ ID NO: 230199 - DNA, 22 bp, Artificial sequence
  SiRNA target sequence
gttttatctgaaatgtttggta

SEQ ID NO: 230200 - DNA, 22 bp, Artificial sequence
  SiRNA target sequence
ttttatctgaaatgtttggtag

SEQ ID NO: 230201 - DNA, 22 bp, Artificial sequence
  SiRNA target sequence
tttatctgaaatgtttggtagt

SEQ ID NO: 230202 - DNA, 22 bp, Artificial sequence
  SiRNA target sequence
ttatctgaaatgtttggtagtt

SEQ ID NO: 230203 - DNA, 22 bp, Artificial sequence
  SiRNA target sequence
tatctgaaatgtttggtagttt

SEQ ID NO: 230204 - DNA, 22 bp, Artificial sequence
  SiRNA target sequence
atctgaaatgtttggtagtttg

SEQ ID NO: 230205 - DNA, 22 bp, Artificial sequence
  SiRNA target sequence
tctgaaatgtttggtagtttga

SEQ ID NO: 230206 - DNA, 22 bp, Artificial sequence
  SiRNA target sequence
ctgaaatgtttggtagtttgat

SEQ ID NO: 230207 - DNA, 22 bp, Artificial sequence
  SiRNA target sequence
tgaaatgtttggtagtttgatt

SEQ ID NO: 230208 - DNA, 22 bp, Artificial sequence
  SiRNA target sequence
gaaatgtttggtagtttgattc

SEQ ID NO: 230209 - DNA, 22 bp, Artificial sequence
  SiRNA target sequence
aaatgtttggtagtttgattct

SEQ ID NO: 230210 - DNA, 22 bp, Artificial sequence
  SiRNA target sequence
aatgtttggtagtttgattctt

SEQ ID NO: 230211 - DNA, 22 bp, Artificial sequence
  SiRNA target sequence
atgtttggtagtttgattcttt

SEQ ID NO: 230212 - DNA, 22 bp, Artificial sequence
  SiRNA target sequence
tgtttggtagtttgattctttc

SEQ ID NO: 230213 - DNA, 22 bp, Artificial sequence
  SiRNA target sequence
gtttggtagtttgattctttca

SEQ ID NO: 230214 - DNA, 22 bp, Artificial sequence
  SiRNA target sequence
tttggtagtttgattctttcat

SEQ ID NO: 230215 - DNA, 22 bp, Artificial sequence
  SiRNA target sequence
ttggtagtttgattctttcata

SEQ ID NO: 230216 - DNA, 22 bp, Artificial sequence
  SiRNA target sequence
tggtagtttgattctttcatat

SEQ ID NO: 230217 - DNA, 22 bp, Artificial sequence
  SiRNA target sequence
ggtagtttgattctttcatatt

SEQ ID NO: 230218 - DNA, 22 bp, Artificial sequence
  SiRNA target sequence
gtagtttgattctttcatattt

SEQ ID NO: 230219 - DNA, 22 bp, Artificial sequence
  SiRNA target sequence
tagtttgattctttcatattta

SEQ ID NO: 230220 - DNA, 22 bp, Artificial sequence
  SiRNA target sequence
agtttgattctttcatatttat

SEQ ID NO: 230221 - DNA, 22 bp, Artificial sequence
  SiRNA target sequence
gtttgattctttcatatttatt

SEQ ID NO: 230222 - DNA, 22 bp, Artificial sequence
  SiRNA target sequence
tttgattctttcatatttattt

SEQ ID NO: 230223 - DNA, 22 bp, Artificial sequence
  SiRNA target sequence
ttgattctttcatatttattta

SEQ ID NO: 230224 - DNA, 22 bp, Artificial sequence
  SiRNA target sequence
tgattctttcatatttatttat

SEQ ID NO: 230225 - DNA, 22 bp, Artificial sequence
  SiRNA target sequence
gattctttcatatttatttatg

SEQ ID NO: 230226 - DNA, 22 bp, Artificial sequence
  SiRNA target sequence
attctttcatatttatttatga

SEQ ID NO: 230227 - DNA, 22 bp, Artificial sequence
  SiRNA target sequence
ttctttcatatttatttatgac

SEQ ID NO: 230228 - DNA, 22 bp, Artificial sequence
  SiRNA target sequence
tctttcatatttatttatgacg

SEQ ID NO: 230229 - DNA, 22 bp, Artificial sequence
  SiRNA target sequence
ctttcatatttatttatgacgt

SEQ ID NO: 230230 - DNA, 22 bp, Artificial sequence
  SiRNA target sequence
tttcatatttatttatgacgtt

SEQ ID NO: 230231 - DNA, 22 bp, Artificial sequence
  SiRNA target sequence
ttcatatttatttatgacgttt

SEQ ID NO: 230232 - DNA, 22 bp, Artificial sequence
  SiRNA target sequence
tcatatttatttatgacgtttg

SEQ ID NO: 230233 - DNA, 22 bp, Artificial sequence
  SiRNA target sequence
catatttatttatgacgtttgc

SEQ ID NO: 230234 - DNA, 22 bp, Artificial sequence
  SiRNA target sequence
atatttatttatgacgtttgct

SEQ ID NO: 230235 - DNA, 22 bp, Artificial sequence
  SiRNA target sequence
tatttatttatgacgtttgcta

SEQ ID NO: 230236 - DNA, 22 bp, Artificial sequence
  SiRNA target sequence
atttatttatgacgtttgctaa

SEQ ID NO: 230237 - DNA, 22 bp, Artificial sequence
  SiRNA target sequence
tttatttatgacgtttgctaat

SEQ ID NO: 230238 - DNA, 22 bp, Artificial sequence
  SiRNA target sequence
ttatttatgacgtttgctaatg

SEQ ID NO: 230239 - DNA, 22 bp, Artificial sequence
  SiRNA target sequence
tatttatgacgtttgctaatgg

SEQ ID NO: 230240 - DNA, 22 bp, Artificial sequence
  SiRNA target sequence
atttatgacgtttgctaatggt

SEQ ID NO: 230241 - DNA, 22 bp, Artificial sequence
  SiRNA target sequence
tttatgacgtttgctaatggtc

SEQ ID NO: 230242 - DNA, 22 bp, Artificial sequence
  SiRNA target sequence
ttatgacgtttgctaatggtct

SEQ ID NO: 230243 - DNA, 22 bp, Artificial sequence
  SiRNA target sequence
tatgacgtttgctaatggtctt

SEQ ID NO: 230244 - DNA, 22 bp, Artificial sequence
  SiRNA target sequence
atgacgtttgctaatggtcttt

SEQ ID NO: 230245 - DNA, 22 bp, Artificial sequence
  SiRNA target sequence
tgacgtttgctaatggtctttc

SEQ ID NO: 230246 - DNA, 22 bp, Artificial sequence
  SiRNA target sequence
gacgtttgctaatggtctttcg

SEQ ID NO: 230247 - DNA, 22 bp, Artificial sequence
  SiRNA target sequence
acgtttgctaatggtctttcga

SEQ ID NO: 230248 - DNA, 22 bp, Artificial sequence
  SiRNA target sequence
cgtttgctaatggtctttcgac

SEQ ID NO: 230249 - DNA, 22 bp, Artificial sequence
  SiRNA target sequence
gtttgctaatggtctttcgact

SEQ ID NO: 230250 - DNA, 22 bp, Artificial sequence
  SiRNA target sequence
tttgctaatggtctttcgactc

SEQ ID NO: 230251 - DNA, 22 bp, Artificial sequence
  SiRNA target sequence
ttgctaatggtctttcgactcc

SEQ ID NO: 230252 - DNA, 22 bp, Artificial sequence
  SiRNA target sequence
tgctaatggtctttcgactcct

SEQ ID NO: 230253 - DNA, 22 bp, Artificial sequence
  SiRNA target sequence
gctaatggtctttcgactcctg

SEQ ID NO: 230254 - DNA, 22 bp, Artificial sequence
  SiRNA target sequence
ctaatggtctttcgactcctgg

SEQ ID NO: 230255 - DNA, 22 bp, Artificial sequence
  SiRNA target sequence
taatggtctttcgactcctgga

SEQ ID NO: 230256 - DNA, 22 bp, Artificial sequence
  SiRNA target sequence
aatggtctttcgactcctggac

SEQ ID NO: 230257 - DNA, 22 bp, Artificial sequence
  SiRNA target sequence
atggtctttcgactcctggaca

SEQ ID NO: 230258 - DNA, 22 bp, Artificial sequence
  SiRNA target sequence
tggtctttcgactcctggacag

SEQ ID NO: 230259 - DNA, 22 bp, Artificial sequence
  SiRNA target sequence
ggtctttcgactcctggacagt

SEQ ID NO: 230260 - DNA, 22 bp, Artificial sequence
  SiRNA target sequence
gtctttcgactcctggacagtc

SEQ ID NO: 230261 - DNA, 22 bp, Artificial sequence
  SiRNA target sequence
tctttcgactcctggacagtcc

SEQ ID NO: 230262 - DNA, 22 bp, Artificial sequence
  SiRNA target sequence
ctttcgactcctggacagtccg

SEQ ID NO: 230263 - DNA, 22 bp, Artificial sequence
  SiRNA target sequence
tttcgactcctggacagtccgc

SEQ ID NO: 230264 - DNA, 22 bp, Artificial sequence
  SiRNA target sequence
ttcgactcctggacagtccgct

SEQ ID NO: 230265 - DNA, 22 bp, Artificial sequence
  SiRNA target sequence
tcgactcctggacagtccgcta

SEQ ID NO: 230266 - DNA, 22 bp, Artificial sequence
  SiRNA target sequence
cgactcctggacagtccgctag

SEQ ID NO: 230267 - DNA, 22 bp, Artificial sequence
  SiRNA target sequence
gactcctggacagtccgctaga

SEQ ID NO: 230268 - DNA, 22 bp, Artificial sequence
  SiRNA target sequence
actcctggacagtccgctagat

SEQ ID NO: 230269 - DNA, 22 bp, Artificial sequence
  SiRNA target sequence
ctcctggacagtccgctagatt

SEQ ID NO: 230270 - DNA, 22 bp, Artificial sequence
  SiRNA target sequence
tcctggacagtccgctagattt

SEQ ID NO: 230271 - DNA, 22 bp, Artificial sequence
  SiRNA target sequence
cctggacagtccgctagatttg

SEQ ID NO: 230272 - DNA, 22 bp, Artificial sequence
  SiRNA target sequence
ctggacagtccgctagatttgt

SEQ ID NO: 230273 - DNA, 22 bp, Artificial sequence
  SiRNA target sequence
tggacagtccgctagatttgtc

SEQ ID NO: 230274 - DNA, 22 bp, Artificial sequence
  SiRNA target sequence
ggacagtccgctagatttgtcc

SEQ ID NO: 230275 - DNA, 22 bp, Artificial sequence
  SiRNA target sequence
gacagtccgctagatttgtccc

SEQ ID NO: 230276 - DNA, 22 bp, Artificial sequence
  SiRNA target sequence
acagtccgctagatttgtccct

SEQ ID NO: 230277 - DNA, 22 bp, Artificial sequence
  SiRNA target sequence
cagtccgctagatttgtccctt

SEQ ID NO: 230278 - DNA, 22 bp, Artificial sequence
  SiRNA target sequence
agtccgctagatttgtcccttt

SEQ ID NO: 230279 - DNA, 22 bp, Artificial sequence
  SiRNA target sequence
gtccgctagatttgtcccttta

SEQ ID NO: 230280 - DNA, 22 bp, Artificial sequence
  SiRNA target sequence
tccgctagatttgtccctttat

SEQ ID NO: 230281 - DNA, 22 bp, Artificial sequence
  SiRNA target sequence
ccgctagatttgtccctttatt

SEQ ID NO: 230282 - DNA, 22 bp, Artificial sequence
  SiRNA target sequence
cgctagatttgtccctttattt

SEQ ID NO: 230283 - DNA, 22 bp, Artificial sequence
  SiRNA target sequence
gctagatttgtccctttatttt

SEQ ID NO: 230284 - DNA, 22 bp, Artificial sequence
  SiRNA target sequence
ctagatttgtccctttatttta

SEQ ID NO: 230285 - DNA, 22 bp, Artificial sequence
  SiRNA target sequence
tagatttgtccctttattttat

SEQ ID NO: 230286 - DNA, 22 bp, Artificial sequence
  SiRNA target sequence
agatttgtccctttattttatg

SEQ ID NO: 230287 - DNA, 22 bp, Artificial sequence
  SiRNA target sequence
gatttgtccctttattttatgt

SEQ ID NO: 230288 - DNA, 22 bp, Artificial sequence
  SiRNA target sequence
atttgtccctttattttatgtt

SEQ ID NO: 230289 - DNA, 22 bp, Artificial sequence
  SiRNA target sequence
tttgtccctttattttatgttg

SEQ ID NO: 230290 - DNA, 22 bp, Artificial sequence
  SiRNA target sequence
ttgtccctttattttatgttgg

SEQ ID NO: 230291 - DNA, 22 bp, Artificial sequence
  SiRNA target sequence
tgtccctttattttatgttgga

SEQ ID NO: 230292 - DNA, 22 bp, Artificial sequence
  SiRNA target sequence
gtccctttattttatgttggat

SEQ ID NO: 230293 - DNA, 22 bp, Artificial sequence
  SiRNA target sequence
tccctttattttatgttggatc

SEQ ID NO: 230294 - DNA, 22 bp, Artificial sequence
  SiRNA target sequence
ccctttattttatgttggatct

SEQ ID NO: 230295 - DNA, 22 bp, Artificial sequence
  SiRNA target sequence
cctttattttatgttggatcta

SEQ ID NO: 230296 - DNA, 22 bp, Artificial sequence
  SiRNA target sequence
ctttattttatgttggatctaa

SEQ ID NO: 230297 - DNA, 22 bp, Artificial sequence
  SiRNA target sequence
tttattttatgttggatctaat

SEQ ID NO: 230298 - DNA, 22 bp, Artificial sequence
  SiRNA target sequence
ttattttatgttggatctaatt

SEQ ID NO: 230299 - DNA, 22 bp, Artificial sequence
  SiRNA target sequence
tattttatgttggatctaattt

SEQ ID NO: 230300 - DNA, 22 bp, Artificial sequence
  SiRNA target sequence
attttatgttggatctaatttg

SEQ ID NO: 230301 - DNA, 22 bp, Artificial sequence
  SiRNA target sequence
ttttatgttggatctaatttgg

SEQ ID NO: 230302 - DNA, 22 bp, Artificial sequence
  SiRNA target sequence
tttatgttggatctaatttggc

SEQ ID NO: 230303 - DNA, 22 bp, Artificial sequence
  SiRNA target sequence
ttatgttggatctaatttggct

SEQ ID NO: 230304 - DNA, 22 bp, Artificial sequence
  SiRNA target sequence
tatgttggatctaatttggctt

SEQ ID NO: 230305 - DNA, 22 bp, Artificial sequence
  SiRNA target sequence
atgttggatctaatttggcttt

SEQ ID NO: 230306 - DNA, 22 bp, Artificial sequence
  SiRNA target sequence
tgttggatctaatttggcttta

SEQ ID NO: 230307 - DNA, 22 bp, Artificial sequence
  SiRNA target sequence
gttggatctaatttggctttac

SEQ ID NO: 230308 - DNA, 22 bp, Artificial sequence
  SiRNA target sequence
ttggatctaatttggctttact

SEQ ID NO: 230309 - DNA, 22 bp, Artificial sequence
  SiRNA target sequence
tggatctaatttggctttactt

SEQ ID NO: 230310 - DNA, 22 bp, Artificial sequence
  SiRNA target sequence
ggatctaatttggctttacttc

SEQ ID NO: 230311 - DNA, 22 bp, Artificial sequence
  SiRNA target sequence
gatctaatttggctttacttct

SEQ ID NO: 230312 - DNA, 22 bp, Artificial sequence
  SiRNA target sequence
atctaatttggctttacttctt

SEQ ID NO: 230313 - DNA, 22 bp, Artificial sequence
  SiRNA target sequence
tctaatttggctttacttcttt

SEQ ID NO: 230314 - DNA, 22 bp, Artificial sequence
  SiRNA target sequence
ctaatttggctttacttctttc

SEQ ID NO: 230315 - DNA, 22 bp, Artificial sequence
  SiRNA target sequence
taatttggctttacttctttca

SEQ ID NO: 230316 - DNA, 22 bp, Artificial sequence
  SiRNA target sequence
aatttggctttacttctttcag

SEQ ID NO: 230317 - DNA, 22 bp, Artificial sequence
  SiRNA target sequence
atttggctttacttctttcagg

SEQ ID NO: 230318 - DNA, 22 bp, Artificial sequence
  SiRNA target sequence
tttggctttacttctttcagga

SEQ ID NO: 230319 - DNA, 22 bp, Artificial sequence
  SiRNA target sequence
ttggctttacttctttcaggaa

SEQ ID NO: 230320 - DNA, 22 bp, Artificial sequence
  SiRNA target sequence
tggctttacttctttcaggaat

SEQ ID NO: 230321 - DNA, 22 bp, Artificial sequence
  SiRNA target sequence
ggctttacttctttcaggaatg

SEQ ID NO: 230322 - DNA, 22 bp, Artificial sequence
  SiRNA target sequence
gctttacttctttcaggaatga

SEQ ID NO: 230323 - DNA, 22 bp, Artificial sequence
  SiRNA target sequence
ctttacttctttcaggaatgat

SEQ ID NO: 230324 - DNA, 22 bp, Artificial sequence
  SiRNA target sequence
tttacttctttcaggaatgata

SEQ ID NO: 230325 - DNA, 22 bp, Artificial sequence
  SiRNA target sequence
ttacttctttcaggaatgataa

SEQ ID NO: 230326 - DNA, 22 bp, Artificial sequence
  SiRNA target sequence
tacttctttcaggaatgataaa

SEQ ID NO: 230327 - DNA, 22 bp, Artificial sequence
  SiRNA target sequence
acttctttcaggaatgataaat

SEQ ID NO: 230328 - DNA, 22 bp, Artificial sequence
  SiRNA target sequence
cttctttcaggaatgataaatt

SEQ ID NO: 230329 - DNA, 22 bp, Artificial sequence
  SiRNA target sequence
ttctttcaggaatgataaatta

SEQ ID NO: 230330 - DNA, 22 bp, Artificial sequence
  SiRNA target sequence
tctttcaggaatgataaattac

SEQ ID NO: 230331 - DNA, 22 bp, Artificial sequence
  SiRNA target sequence
ctttcaggaatgataaattact

SEQ ID NO: 230332 - DNA, 22 bp, Artificial sequence
  SiRNA target sequence
tttcaggaatgataaattactt

SEQ ID NO: 230333 - DNA, 22 bp, Artificial sequence
  SiRNA target sequence
ttcaggaatgataaattacttt

SEQ ID NO: 230334 - DNA, 22 bp, Artificial sequence
  SiRNA target sequence
tcaggaatgataaattactttt

SEQ ID NO: 230335 - DNA, 22 bp, Artificial sequence
  SiRNA target sequence
caggaatgataaattactttta

SEQ ID NO: 230336 - DNA, 22 bp, Artificial sequence
  SiRNA target sequence
aggaatgataaattacttttat

SEQ ID NO: 230337 - DNA, 22 bp, Artificial sequence
  SiRNA target sequence
ggaatgataaattacttttata

SEQ ID NO: 230338 - DNA, 22 bp, Artificial sequence
  SiRNA target sequence
gaatgataaattacttttatag

SEQ ID NO: 230339 - DNA, 22 bp, Artificial sequence
  SiRNA target sequence
aatgataaattacttttatagt

SEQ ID NO: 230340 - DNA, 22 bp, Artificial sequence
  SiRNA target sequence
atgataaattacttttatagtg

SEQ ID NO: 230341 - DNA, 22 bp, Artificial sequence
  SiRNA target sequence
tgataaattacttttatagtgt

SEQ ID NO: 230342 - DNA, 22 bp, Artificial sequence
  SiRNA target sequence
gataaattacttttatagtgta

SEQ ID NO: 230343 - DNA, 22 bp, Artificial sequence
  SiRNA target sequence
ataaattacttttatagtgtaa

SEQ ID NO: 230344 - DNA, 22 bp, Artificial sequence
  SiRNA target sequence
taaattacttttatagtgtaag

SEQ ID NO: 230345 - DNA, 22 bp, Artificial sequence
  SiRNA target sequence
aaattacttttatagtgtaagt

SEQ ID NO: 230346 - DNA, 22 bp, Artificial sequence
  SiRNA target sequence
aattacttttatagtgtaagta

SEQ ID NO: 230347 - DNA, 22 bp, Artificial sequence
  SiRNA target sequence
attacttttatagtgtaagtaa

SEQ ID NO: 230348 - DNA, 22 bp, Artificial sequence
  SiRNA target sequence
ttacttttatagtgtaagtaaa

SEQ ID NO: 230349 - DNA, 22 bp, Artificial sequence
  SiRNA target sequence
tacttttatagtgtaagtaaat

SEQ ID NO: 230350 - DNA, 22 bp, Artificial sequence
  SiRNA target sequence
acttttatagtgtaagtaaatc

SEQ ID NO: 230351 - DNA, 22 bp, Artificial sequence
  SiRNA target sequence
cttttatagtgtaagtaaatct

SEQ ID NO: 230352 - DNA, 22 bp, Artificial sequence
  SiRNA target sequence
ttttatagtgtaagtaaatcta

SEQ ID NO: 230353 - DNA, 22 bp, Artificial sequence
  SiRNA target sequence
tttatagtgtaagtaaatctaa

SEQ ID NO: 230354 - DNA, 22 bp, Artificial sequence
  SiRNA target sequence
ttatagtgtaagtaaatctaaa

SEQ ID NO: 230355 - DNA, 22 bp, Artificial sequence
  SiRNA target sequence
tatagtgtaagtaaatctaaaa

SEQ ID NO: 230356 - DNA, 22 bp, Artificial sequence
  SiRNA target sequence
atagtgtaagtaaatctaaaat

SEQ ID NO: 230357 - DNA, 22 bp, Artificial sequence
  SiRNA target sequence
tagtgtaagtaaatctaaaatg

SEQ ID NO: 230358 - DNA, 22 bp, Artificial sequence
  SiRNA target sequence
agtgtaagtaaatctaaaatgt

SEQ ID NO: 230359 - DNA, 22 bp, Artificial sequence
  SiRNA target sequence
gtgtaagtaaatctaaaatgtc

SEQ ID NO: 230360 - DNA, 22 bp, Artificial sequence
  SiRNA target sequence
tgtaagtaaatctaaaatgtcg

SEQ ID NO: 230361 - DNA, 22 bp, Artificial sequence
  SiRNA target sequence
gtaagtaaatctaaaatgtcgt

SEQ ID NO: 230362 - DNA, 22 bp, Artificial sequence
  SiRNA target sequence
taagtaaatctaaaatgtcgta

SEQ ID NO: 230363 - DNA, 22 bp, Artificial sequence
  SiRNA target sequence
aagtaaatctaaaatgtcgtat

SEQ ID NO: 230364 - DNA, 22 bp, Artificial sequence
  SiRNA target sequence
agtaaatctaaaatgtcgtatg

SEQ ID NO: 230365 - DNA, 22 bp, Artificial sequence
  SiRNA target sequence
gtaaatctaaaatgtcgtatgt

SEQ ID NO: 230366 - DNA, 22 bp, Artificial sequence
  SiRNA target sequence
taaatctaaaatgtcgtatgtt

SEQ ID NO: 230367 - DNA, 22 bp, Artificial sequence
  SiRNA target sequence
aaatctaaaatgtcgtatgttg

SEQ ID NO: 230368 - DNA, 22 bp, Artificial sequence
  SiRNA target sequence
aatctaaaatgtcgtatgttgc

SEQ ID NO: 230369 - DNA, 22 bp, Artificial sequence
  SiRNA target sequence
atctaaaatgtcgtatgttgcg

SEQ ID NO: 230370 - DNA, 22 bp, Artificial sequence
  SiRNA target sequence
tctaaaatgtcgtatgttgcgg

SEQ ID NO: 230371 - DNA, 22 bp, Artificial sequence
  SiRNA target sequence
ctaaaatgtcgtatgttgcggc

SEQ ID NO: 230372 - DNA, 22 bp, Artificial sequence
  SiRNA target sequence
taaaatgtcgtatgttgcggcc

SEQ ID NO: 230373 - DNA, 22 bp, Artificial sequence
  SiRNA target sequence
aaaatgtcgtatgttgcggccg

SEQ ID NO: 230374 - DNA, 22 bp, Artificial sequence
  SiRNA target sequence
aaatgtcgtatgttgcggccga

SEQ ID NO: 230375 - DNA, 22 bp, Artificial sequence
  SiRNA target sequence
aatgtcgtatgttgcggccgaa

SEQ ID NO: 230376 - DNA, 22 bp, Artificial sequence
  SiRNA target sequence
atgtcgtatgttgcggccgaaa

SEQ ID NO: 230377 - DNA, 22 bp, Artificial sequence
  SiRNA target sequence
tgtcgtatgttgcggccgaaag

SEQ ID NO: 230378 - DNA, 22 bp, Artificial sequence
  SiRNA target sequence
gtcgtatgttgcggccgaaaga

SEQ ID NO: 230379 - DNA, 22 bp, Artificial sequence
  SiRNA target sequence
tcgtatgttgcggccgaaagat

SEQ ID NO: 230380 - DNA, 22 bp, Artificial sequence
  SiRNA target sequence
cgtatgttgcggccgaaagatt

SEQ ID NO: 230381 - DNA, 22 bp, Artificial sequence
  SiRNA target sequence
gtatgttgcggccgaaagattt

SEQ ID NO: 230382 - DNA, 22 bp, Artificial sequence
  SiRNA target sequence
tatgttgcggccgaaagatttt

SEQ ID NO: 230383 - DNA, 22 bp, Artificial sequence
  SiRNA target sequence
atgttgcggccgaaagattttt

SEQ ID NO: 230384 - DNA, 22 bp, Artificial sequence
  SiRNA target sequence
tgttgcggccgaaagatttttt

SEQ ID NO: 230385 - DNA, 22 bp, Artificial sequence
  SiRNA target sequence
gttgcggccgaaagatttttta

SEQ ID NO: 230386 - DNA, 22 bp, Artificial sequence
  SiRNA target sequence
ttgcggccgaaagattttttaa

SEQ ID NO: 230387 - DNA, 22 bp, Artificial sequence
  SiRNA target sequence
tgcggccgaaagattttttaat

SEQ ID NO: 230388 - DNA, 22 bp, Artificial sequence
  SiRNA target sequence
gcggccgaaagattttttaatg

SEQ ID NO: 230389 - DNA, 22 bp, Artificial sequence
  SiRNA target sequence
cggccgaaagattttttaatgg

SEQ ID NO: 230390 - DNA, 22 bp, Artificial sequence
  SiRNA target sequence
ggccgaaagattttttaatgga

SEQ ID NO: 230391 - DNA, 22 bp, Artificial sequence
  SiRNA target sequence
gccgaaagattttttaatggat

SEQ ID NO: 230392 - DNA, 22 bp, Artificial sequence
  SiRNA target sequence
ccgaaagattttttaatggatt

SEQ ID NO: 230393 - DNA, 22 bp, Artificial sequence
  SiRNA target sequence
cgaaagattttttaatggattt

SEQ ID NO: 230394 - DNA, 22 bp, Artificial sequence
  SiRNA target sequence
gaaagattttttaatggatttt

SEQ ID NO: 230395 - DNA, 22 bp, Artificial sequence
  SiRNA target sequence
aaagattttttaatggattttt

SEQ ID NO: 230396 - DNA, 22 bp, Artificial sequence
  SiRNA target sequence
aagattttttaatggatttttt

SEQ ID NO: 230397 - DNA, 22 bp, Artificial sequence
  SiRNA target sequence
agattttttaatggattttttt

SEQ ID NO: 230398 - DNA, 22 bp, Artificial sequence
  SiRNA target sequence
gattttttaatggatttttttg

SEQ ID NO: 230399 - DNA, 22 bp, Artificial sequence
  SiRNA target sequence
attttttaatggatttttttgt

SEQ ID NO: 230400 - DNA, 22 bp, Artificial sequence
  SiRNA target sequence
ttttttaatggatttttttgtc

SEQ ID NO: 230401 - DNA, 22 bp, Artificial sequence
  SiRNA target sequence
tttttaatggatttttttgtct

SEQ ID NO: 230402 - DNA, 22 bp, Artificial sequence
  SiRNA target sequence
ttttaatggatttttttgtctg

SEQ ID NO: 230403 - DNA, 22 bp, Artificial sequence
  SiRNA target sequence
tttaatggatttttttgtctga

SEQ ID NO: 230404 - DNA, 22 bp, Artificial sequence
  SiRNA target sequence
ttaatggatttttttgtctgag

SEQ ID NO: 230405 - DNA, 22 bp, Artificial sequence
  SiRNA target sequence
taatggatttttttgtctgagt

SEQ ID NO: 230406 - DNA, 22 bp, Artificial sequence
  SiRNA target sequence
aatggatttttttgtctgagtg

SEQ ID NO: 230407 - DNA, 22 bp, Artificial sequence
  SiRNA target sequence
atggatttttttgtctgagtgg

SEQ ID NO: 230408 - DNA, 22 bp, Artificial sequence
  SiRNA target sequence
tggatttttttgtctgagtgga

SEQ ID NO: 230409 - DNA, 22 bp, Artificial sequence
  SiRNA target sequence
ggatttttttgtctgagtggaa

SEQ ID NO: 230410 - DNA, 22 bp, Artificial sequence
  SiRNA target sequence
gatttttttgtctgagtggaat

SEQ ID NO: 230411 - DNA, 22 bp, Artificial sequence
  SiRNA target sequence
atttttttgtctgagtggaatt

SEQ ID NO: 230412 - DNA, 22 bp, Artificial sequence
  SiRNA target sequence
tttttttgtctgagtggaattc

SEQ ID NO: 230413 - DNA, 22 bp, Artificial sequence
  SiRNA target sequence
ttttttgtctgagtggaattct

SEQ ID NO: 230414 - DNA, 22 bp, Artificial sequence
  SiRNA target sequence
tttttgtctgagtggaattctc

SEQ ID NO: 230415 - DNA, 22 bp, Artificial sequence
  SiRNA target sequence
ttttgtctgagtggaattctct

SEQ ID NO: 230416 - DNA, 22 bp, Artificial sequence
  SiRNA target sequence
tttgtctgagtggaattctctg

SEQ ID NO: 230417 - DNA, 22 bp, Artificial sequence
  SiRNA target sequence
ttgtctgagtggaattctctgt

SEQ ID NO: 230418 - DNA, 22 bp, Artificial sequence
  SiRNA target sequence
tgtctgagtggaattctctgtg

SEQ ID NO: 230419 - DNA, 22 bp, Artificial sequence
  SiRNA target sequence
gtctgagtggaattctctgtgc

SEQ ID NO: 230420 - DNA, 22 bp, Artificial sequence
  SiRNA target sequence
tctgagtggaattctctgtgct

SEQ ID NO: 230421 - DNA, 22 bp, Artificial sequence
  SiRNA target sequence
ctgagtggaattctctgtgctg

SEQ ID NO: 230422 - DNA, 22 bp, Artificial sequence
  SiRNA target sequence
tgagtggaattctctgtgctgt

SEQ ID NO: 230423 - DNA, 22 bp, Artificial sequence
  SiRNA target sequence
gagtggaattctctgtgctgta

SEQ ID NO: 230424 - DNA, 22 bp, Artificial sequence
  SiRNA target sequence
agtggaattctctgtgctgtaa

SEQ ID NO: 230425 - DNA, 22 bp, Artificial sequence
  SiRNA target sequence
gtggaattctctgtgctgtaat

SEQ ID NO: 230426 - DNA, 22 bp, Artificial sequence
  SiRNA target sequence
tggaattctctgtgctgtaatt

SEQ ID NO: 230427 - DNA, 22 bp, Artificial sequence
  SiRNA target sequence
ggaattctctgtgctgtaattt

SEQ ID NO: 230428 - DNA, 22 bp, Artificial sequence
  SiRNA target sequence
gaattctctgtgctgtaattta

SEQ ID NO: 230429 - DNA, 22 bp, Artificial sequence
  SiRNA target sequence
aattctctgtgctgtaatttat

SEQ ID NO: 230430 - DNA, 22 bp, Artificial sequence
  SiRNA target sequence
attctctgtgctgtaatttatc

SEQ ID NO: 230431 - DNA, 22 bp, Artificial sequence
  SiRNA target sequence
ttctctgtgctgtaatttatct

SEQ ID NO: 230432 - DNA, 22 bp, Artificial sequence
  SiRNA target sequence
tctctgtgctgtaatttatctt

SEQ ID NO: 230433 - DNA, 22 bp, Artificial sequence
  SiRNA target sequence
ctctgtgctgtaatttatcttc

SEQ ID NO: 230434 - DNA, 22 bp, Artificial sequence
  SiRNA target sequence
tctgtgctgtaatttatcttct

SEQ ID NO: 230435 - DNA, 22 bp, Artificial sequence
  SiRNA target sequence
ctgtgctgtaatttatcttcta

SEQ ID NO: 230436 - DNA, 22 bp, Artificial sequence
  SiRNA target sequence
tgtgctgtaatttatcttctaa

SEQ ID NO: 230437 - DNA, 22 bp, Artificial sequence
  SiRNA target sequence
gtgctgtaatttatcttctaaa

SEQ ID NO: 230438 - DNA, 22 bp, Artificial sequence
  SiRNA target sequence
tgctgtaatttatcttctaaaa

SEQ ID NO: 230439 - DNA, 22 bp, Artificial sequence
  SiRNA target sequence
gctgtaatttatcttctaaaaa

SEQ ID NO: 230440 - DNA, 22 bp, Artificial sequence
  SiRNA target sequence
ctgtaatttatcttctaaaaaa

SEQ ID NO: 230441 - DNA, 22 bp, Artificial sequence
  SiRNA target sequence
tgtaatttatcttctaaaaaaa

SEQ ID NO: 230442 - DNA, 22 bp, Artificial sequence
  SiRNA target sequence
gtaatttatcttctaaaaaaat

SEQ ID NO: 230443 - DNA, 22 bp, Artificial sequence
  SiRNA target sequence
taatttatcttctaaaaaaata

SEQ ID NO: 230444 - DNA, 22 bp, Artificial sequence
  SiRNA target sequence
aatttatcttctaaaaaaatat

SEQ ID NO: 230445 - DNA, 22 bp, Artificial sequence
  SiRNA target sequence
atttatcttctaaaaaaatatt

SEQ ID NO: 230446 - DNA, 22 bp, Artificial sequence
  SiRNA target sequence
tttatcttctaaaaaaatattt

SEQ ID NO: 230447 - DNA, 22 bp, Artificial sequence
  SiRNA target sequence
ttatcttctaaaaaaatattta

SEQ ID NO: 230448 - DNA, 22 bp, Artificial sequence
  SiRNA target sequence
tatcttctaaaaaaatatttag

SEQ ID NO: 230449 - DNA, 22 bp, Artificial sequence
  SiRNA target sequence
atcttctaaaaaaatatttaga

SEQ ID NO: 230450 - DNA, 22 bp, Artificial sequence
  SiRNA target sequence
tcttctaaaaaaatatttagaa

SEQ ID NO: 230451 - DNA, 22 bp, Artificial sequence
  SiRNA target sequence
cttctaaaaaaatatttagaaa

SEQ ID NO: 230452 - DNA, 22 bp, Artificial sequence
  SiRNA target sequence
ttctaaaaaaatatttagaaaa

SEQ ID NO: 230453 - DNA, 22 bp, Artificial sequence
  SiRNA target sequence
tctaaaaaaatatttagaaaat

SEQ ID NO: 230454 - DNA, 22 bp, Artificial sequence
  SiRNA target sequence
ctaaaaaaatatttagaaaata

SEQ ID NO: 230455 - DNA, 22 bp, Artificial sequence
  SiRNA target sequence
taaaaaaatatttagaaaataa

SEQ ID NO: 230456 - DNA, 22 bp, Artificial sequence
  SiRNA target sequence
aaaaaaatatttagaaaataat

SEQ ID NO: 230457 - DNA, 22 bp, Artificial sequence
  SiRNA target sequence
aaaaaatatttagaaaataatg

SEQ ID NO: 230458 - DNA, 22 bp, Artificial sequence
  SiRNA target sequence
aaaaatatttagaaaataatgt

SEQ ID NO: 230459 - DNA, 22 bp, Artificial sequence
  SiRNA target sequence
aaaatatttagaaaataatgtt

SEQ ID NO: 230460 - DNA, 22 bp, Artificial sequence
  SiRNA target sequence
aaatatttagaaaataatgtta

SEQ ID NO: 230461 - DNA, 22 bp, Artificial sequence
  SiRNA target sequence
aatatttagaaaataatgttac

SEQ ID NO: 230462 - DNA, 22 bp, Artificial sequence
  SiRNA target sequence
atatttagaaaataatgttact

SEQ ID NO: 230463 - DNA, 22 bp, Artificial sequence
  SiRNA target sequence
tatttagaaaataatgttacta

SEQ ID NO: 230464 - DNA, 22 bp, Artificial sequence
  SiRNA target sequence
atttagaaaataatgttactag

SEQ ID NO: 230465 - DNA, 22 bp, Artificial sequence
  SiRNA target sequence
tttagaaaataatgttactagc

SEQ ID NO: 230466 - DNA, 22 bp, Artificial sequence
  SiRNA target sequence
ttagaaaataatgttactagca

SEQ ID NO: 230467 - DNA, 22 bp, Artificial sequence
  SiRNA target sequence
tagaaaataatgttactagcaa

SEQ ID NO: 230468 - DNA, 22 bp, Artificial sequence
  SiRNA target sequence
agaaaataatgttactagcaaa

SEQ ID NO: 230469 - DNA, 22 bp, Artificial sequence
  SiRNA target sequence
gaaaataatgttactagcaaac

SEQ ID NO: 230470 - DNA, 22 bp, Artificial sequence
  SiRNA target sequence
aaaataatgttactagcaaacc

SEQ ID NO: 230471 - DNA, 22 bp, Artificial sequence
  SiRNA target sequence
aaataatgttactagcaaacca

SEQ ID NO: 230472 - DNA, 22 bp, Artificial sequence
  SiRNA target sequence
aataatgttactagcaaaccaa

SEQ ID NO: 230473 - DNA, 22 bp, Artificial sequence
  SiRNA target sequence
ataatgttactagcaaaccaat

SEQ ID NO: 230474 - DNA, 22 bp, Artificial sequence
  SiRNA target sequence
taatgttactagcaaaccaatg

SEQ ID NO: 230475 - DNA, 22 bp, Artificial sequence
  SiRNA target sequence
aatgttactagcaaaccaatgt

SEQ ID NO: 230476 - DNA, 22 bp, Artificial sequence
  SiRNA target sequence
atgttactagcaaaccaatgtt

SEQ ID NO: 230477 - DNA, 22 bp, Artificial sequence
  SiRNA target sequence
tgttactagcaaaccaatgttt

SEQ ID NO: 230478 - DNA, 22 bp, Artificial sequence
  SiRNA target sequence
gttactagcaaaccaatgtttg

SEQ ID NO: 230479 - DNA, 22 bp, Artificial sequence
  SiRNA target sequence
ttactagcaaaccaatgtttgt

SEQ ID NO: 230480 - DNA, 22 bp, Artificial sequence
  SiRNA target sequence
tactagcaaaccaatgtttgtt

SEQ ID NO: 230481 - DNA, 22 bp, Artificial sequence
  SiRNA target sequence
actagcaaaccaatgtttgtta

SEQ ID NO: 230482 - DNA, 22 bp, Artificial sequence
  SiRNA target sequence
ctagcaaaccaatgtttgttag

SEQ ID NO: 230483 - DNA, 22 bp, Artificial sequence
  SiRNA target sequence
tagcaaaccaatgtttgttaga

SEQ ID NO: 230484 - DNA, 22 bp, Artificial sequence
  SiRNA target sequence
agcaaaccaatgtttgttagaa

SEQ ID NO: 230485 - DNA, 22 bp, Artificial sequence
  SiRNA target sequence
gcaaaccaatgtttgttagaaa

SEQ ID NO: 230486 - DNA, 22 bp, Artificial sequence
  SiRNA target sequence
caaaccaatgtttgttagaaag

SEQ ID NO: 230487 - DNA, 22 bp, Artificial sequence
  SiRNA target sequence
aaaccaatgtttgttagaaaga

SEQ ID NO: 230488 - DNA, 22 bp, Artificial sequence
  SiRNA target sequence
aaccaatgtttgttagaaagac

SEQ ID NO: 230489 - DNA, 22 bp, Artificial sequence
  SiRNA target sequence
accaatgtttgttagaaagact

SEQ ID NO: 230490 - DNA, 22 bp, Artificial sequence
  SiRNA target sequence
ccaatgtttgttagaaagactt

SEQ ID NO: 230491 - DNA, 22 bp, Artificial sequence
  SiRNA target sequence
caatgtttgttagaaagacttt

SEQ ID NO: 230492 - DNA, 22 bp, Artificial sequence
  SiRNA target sequence
aatgtttgttagaaagactttt

SEQ ID NO: 230493 - DNA, 22 bp, Artificial sequence
  SiRNA target sequence
atgtttgttagaaagactttta

SEQ ID NO: 230494 - DNA, 22 bp, Artificial sequence
  SiRNA target sequence
tgtttgttagaaagacttttac

SEQ ID NO: 230495 - DNA, 22 bp, Artificial sequence
  SiRNA target sequence
gtttgttagaaagacttttact

SEQ ID NO: 230496 - DNA, 22 bp, Artificial sequence
  SiRNA target sequence
tttgttagaaagacttttacta

SEQ ID NO: 230497 - DNA, 22 bp, Artificial sequence
  SiRNA target sequence
ttgttagaaagacttttactaa

SEQ ID NO: 230498 - DNA, 22 bp, Artificial sequence
  SiRNA target sequence
tgttagaaagacttttactaaa

SEQ ID NO: 230499 - DNA, 22 bp, Artificial sequence
  SiRNA target sequence
gttagaaagacttttactaaaa

SEQ ID NO: 230500 - DNA, 22 bp, Artificial sequence
  SiRNA target sequence
ttagaaagacttttactaaaaa

SEQ ID NO: 230501 - DNA, 22 bp, Artificial sequence
  SiRNA target sequence
tagaaagacttttactaaaaag

SEQ ID NO: 230502 - DNA, 22 bp, Artificial sequence
  SiRNA target sequence
agaaagacttttactaaaaaga

SEQ ID NO: 230503 - DNA, 22 bp, Artificial sequence
  SiRNA target sequence
gaaagacttttactaaaaagaa

SEQ ID NO: 230504 - DNA, 22 bp, Artificial sequence
  SiRNA target sequence
aaagacttttactaaaaagaag

SEQ ID NO: 230505 - DNA, 22 bp, Artificial sequence
  SiRNA target sequence
aagacttttactaaaaagaaga

SEQ ID NO: 230506 - DNA, 22 bp, Artificial sequence
  SiRNA target sequence
agacttttactaaaaagaagag

SEQ ID NO: 230507 - DNA, 22 bp, Artificial sequence
  SiRNA target sequence
gacttttactaaaaagaagagt

SEQ ID NO: 230508 - DNA, 22 bp, Artificial sequence
  SiRNA target sequence
acttttactaaaaagaagagta

SEQ ID NO: 230509 - DNA, 22 bp, Artificial sequence
  SiRNA target sequence
cttttactaaaaagaagagtaa

SEQ ID NO: 230510 - DNA, 22 bp, Artificial sequence
  SiRNA target sequence
ttttactaaaaagaagagtaaa

SEQ ID NO: 230511 - DNA, 22 bp, Artificial sequence
  SiRNA target sequence
tttactaaaaagaagagtaaag

SEQ ID NO: 230512 - DNA, 22 bp, Artificial sequence
  SiRNA target sequence
ttactaaaaagaagagtaaagt

SEQ ID NO: 230513 - DNA, 22 bp, Artificial sequence
  SiRNA target sequence
tactaaaaagaagagtaaagtg

SEQ ID NO: 230514 - DNA, 22 bp, Artificial sequence
  SiRNA target sequence
actaaaaagaagagtaaagtga

SEQ ID NO: 230515 - DNA, 22 bp, Artificial sequence
  SiRNA target sequence
ctaaaaagaagagtaaagtgaa

SEQ ID NO: 230516 - DNA, 22 bp, Artificial sequence
  SiRNA target sequence
taaaaagaagagtaaagtgaag

SEQ ID NO: 230517 - DNA, 22 bp, Artificial sequence
  SiRNA target sequence
aaaaagaagagtaaagtgaagg

SEQ ID NO: 230518 - DNA, 22 bp, Artificial sequence
  SiRNA target sequence
aaaagaagagtaaagtgaaggt

SEQ ID NO: 230519 - DNA, 22 bp, Artificial sequence
  SiRNA target sequence
aaagaagagtaaagtgaaggtt

SEQ ID NO: 230520 - DNA, 22 bp, Artificial sequence
  SiRNA target sequence
aagaagagtaaagtgaaggttg

SEQ ID NO: 230521 - DNA, 22 bp, Artificial sequence
  SiRNA target sequence
agaagagtaaagtgaaggttgg

SEQ ID NO: 230522 - DNA, 22 bp, Artificial sequence
  SiRNA target sequence
gaagagtaaagtgaaggttgga

SEQ ID NO: 230523 - DNA, 22 bp, Artificial sequence
  SiRNA target sequence
aagagtaaagtgaaggttggat

SEQ ID NO: 230524 - DNA, 22 bp, Artificial sequence
  SiRNA target sequence
agagtaaagtgaaggttggatt

SEQ ID NO: 230525 - DNA, 22 bp, Artificial sequence
  SiRNA target sequence
gagtaaagtgaaggttggattt

SEQ ID NO: 230526 - DNA, 22 bp, Artificial sequence
  SiRNA target sequence
agtaaagtgaaggttggatttg

SEQ ID NO: 230527 - DNA, 22 bp, Artificial sequence
  SiRNA target sequence
gtaaagtgaaggttggatttgt

SEQ ID NO: 230528 - DNA, 22 bp, Artificial sequence
  SiRNA target sequence
taaagtgaaggttggatttgtt

SEQ ID NO: 230529 - DNA, 22 bp, Artificial sequence
  SiRNA target sequence
aaagtgaaggttggatttgttg

SEQ ID NO: 230530 - DNA, 22 bp, Artificial sequence
  SiRNA target sequence
aagtgaaggttggatttgttga

SEQ ID NO: 230531 - DNA, 22 bp, Artificial sequence
  SiRNA target sequence
agtgaaggttggatttgttgat

SEQ ID NO: 230532 - DNA, 22 bp, Artificial sequence
  SiRNA target sequence
gtgaaggttggatttgttgatg

SEQ ID NO: 230533 - DNA, 22 bp, Artificial sequence
  SiRNA target sequence
tgaaggttggatttgttgatgg

SEQ ID NO: 230534 - DNA, 22 bp, Artificial sequence
  SiRNA target sequence
gaaggttggatttgttgatgga

SEQ ID NO: 230535 - DNA, 22 bp, Artificial sequence
  SiRNA target sequence
aaggttggatttgttgatggac

SEQ ID NO: 230536 - DNA, 22 bp, Artificial sequence
  SiRNA target sequence
aggttggatttgttgatggact

SEQ ID NO: 230537 - DNA, 22 bp, Artificial sequence
  SiRNA target sequence
ggttggatttgttgatggactt

SEQ ID NO: 230538 - DNA, 22 bp, Artificial sequence
  SiRNA target sequence
gttggatttgttgatggactta

SEQ ID NO: 230539 - DNA, 22 bp, Artificial sequence
  SiRNA target sequence
ttggatttgttgatggacttat

SEQ ID NO: 230540 - DNA, 22 bp, Artificial sequence
  SiRNA target sequence
tggatttgttgatggacttatt

SEQ ID NO: 230541 - DNA, 22 bp, Artificial sequence
  SiRNA target sequence
ggatttgttgatggacttattg

SEQ ID NO: 230542 - DNA, 22 bp, Artificial sequence
  SiRNA target sequence
gatttgttgatggacttattga

SEQ ID NO: 230543 - DNA, 22 bp, Artificial sequence
  SiRNA target sequence
atttgttgatggacttattgag

SEQ ID NO: 230544 - DNA, 22 bp, Artificial sequence
  SiRNA target sequence
tttgttgatggacttattgaga

SEQ ID NO: 230545 - DNA, 22 bp, Artificial sequence
  SiRNA target sequence
ttgttgatggacttattgagat

SEQ ID NO: 230546 - DNA, 22 bp, Artificial sequence
  SiRNA target sequence
tgttgatggacttattgagatg

SEQ ID NO: 230547 - DNA, 22 bp, Artificial sequence
  SiRNA target sequence
gttgatggacttattgagatga

SEQ ID NO: 230548 - DNA, 22 bp, Artificial sequence
  SiRNA target sequence
ttgatggacttattgagatgag

SEQ ID NO: 230549 - DNA, 22 bp, Artificial sequence
  SiRNA target sequence
tgatggacttattgagatgagt

SEQ ID NO: 230550 - DNA, 22 bp, Artificial sequence
  SiRNA target sequence
gatggacttattgagatgagta

SEQ ID NO: 230551 - DNA, 22 bp, Artificial sequence
  SiRNA target sequence
atggacttattgagatgagtaa

SEQ ID NO: 230552 - DNA, 22 bp, Artificial sequence
  SiRNA target sequence
tggacttattgagatgagtaaa

SEQ ID NO: 230553 - DNA, 22 bp, Artificial sequence
  SiRNA target sequence
ggacttattgagatgagtaaat

SEQ ID NO: 230554 - DNA, 22 bp, Artificial sequence
  SiRNA target sequence
gacttattgagatgagtaaatc

SEQ ID NO: 230555 - DNA, 22 bp, Artificial sequence
  SiRNA target sequence
acttattgagatgagtaaatct

SEQ ID NO: 230556 - DNA, 22 bp, Artificial sequence
  SiRNA target sequence
cttattgagatgagtaaatcta

SEQ ID NO: 230557 - DNA, 22 bp, Artificial sequence
  SiRNA target sequence
ttattgagatgagtaaatctaa

SEQ ID NO: 230558 - DNA, 22 bp, Artificial sequence
  SiRNA target sequence
tattgagatgagtaaatctaaa

SEQ ID NO: 230559 - DNA, 22 bp, Artificial sequence
  SiRNA target sequence
attgagatgagtaaatctaaac

SEQ ID NO: 230560 - DNA, 22 bp, Artificial sequence
  SiRNA target sequence
ttgagatgagtaaatctaaact

SEQ ID NO: 230561 - DNA, 22 bp, Artificial sequence
  SiRNA target sequence
tgagatgagtaaatctaaacta

SEQ ID NO: 230562 - DNA, 22 bp, Artificial sequence
  SiRNA target sequence
gagatgagtaaatctaaactac

SEQ ID NO: 230563 - DNA, 22 bp, Artificial sequence
  SiRNA target sequence
agatgagtaaatctaaactact

SEQ ID NO: 230564 - DNA, 22 bp, Artificial sequence
  SiRNA target sequence
gatgagtaaatctaaactactg

SEQ ID NO: 230565 - DNA, 22 bp, Artificial sequence
  SiRNA target sequence
atgagtaaatctaaactactgt

SEQ ID NO: 230566 - DNA, 22 bp, Artificial sequence
  SiRNA target sequence
tgagtaaatctaaactactgtt

SEQ ID NO: 230567 - DNA, 22 bp, Artificial sequence
  SiRNA target sequence
gagtaaatctaaactactgttg

SEQ ID NO: 230568 - DNA, 22 bp, Artificial sequence
  SiRNA target sequence
agtaaatctaaactactgttga

SEQ ID NO: 230569 - DNA, 22 bp, Artificial sequence
  SiRNA target sequence
gtaaatctaaactactgttgaa

SEQ ID NO: 230570 - DNA, 22 bp, Artificial sequence
  SiRNA target sequence
taaatctaaactactgttgaat

SEQ ID NO: 230571 - DNA, 22 bp, Artificial sequence
  SiRNA target sequence
aaatctaaactactgttgaata

SEQ ID NO: 230572 - DNA, 22 bp, Artificial sequence
  SiRNA target sequence
aatctaaactactgttgaatat

SEQ ID NO: 230573 - DNA, 22 bp, Artificial sequence
  SiRNA target sequence
atctaaactactgttgaatatg

SEQ ID NO: 230574 - DNA, 22 bp, Artificial sequence
  SiRNA target sequence
tctaaactactgttgaatatgt

SEQ ID NO: 230575 - DNA, 22 bp, Artificial sequence
  SiRNA target sequence
ctaaactactgttgaatatgtc

SEQ ID NO: 230576 - DNA, 22 bp, Artificial sequence
  SiRNA target sequence
taaactactgttgaatatgtca

SEQ ID NO: 230577 - DNA, 22 bp, Artificial sequence
  SiRNA target sequence
aaactactgttgaatatgtcat

SEQ ID NO: 230578 - DNA, 22 bp, Artificial sequence
  SiRNA target sequence
aactactgttgaatatgtcatt

SEQ ID NO: 230579 - DNA, 22 bp, Artificial sequence
  SiRNA target sequence
actactgttgaatatgtcatta

SEQ ID NO: 230580 - DNA, 22 bp, Artificial sequence
  SiRNA target sequence
ctactgttgaatatgtcattag

SEQ ID NO: 230581 - DNA, 22 bp, Artificial sequence
  SiRNA target sequence
tactgttgaatatgtcattagt

SEQ ID NO: 230582 - DNA, 22 bp, Artificial sequence
  SiRNA target sequence
actgttgaatatgtcattagtc

SEQ ID NO: 230583 - DNA, 22 bp, Artificial sequence
  SiRNA target sequence
ctgttgaatatgtcattagtcg

SEQ ID NO: 230584 - DNA, 22 bp, Artificial sequence
  SiRNA target sequence
tgttgaatatgtcattagtcgt

SEQ ID NO: 230585 - DNA, 22 bp, Artificial sequence
  SiRNA target sequence
gttgaatatgtcattagtcgta

SEQ ID NO: 230586 - DNA, 22 bp, Artificial sequence
  SiRNA target sequence
ttgaatatgtcattagtcgtat

SEQ ID NO: 230587 - DNA, 22 bp, Artificial sequence
  SiRNA target sequence
tgaatatgtcattagtcgtatt

SEQ ID NO: 230588 - DNA, 22 bp, Artificial sequence
  SiRNA target sequence
gaatatgtcattagtcgtatta

SEQ ID NO: 230589 - DNA, 22 bp, Artificial sequence
  SiRNA target sequence
aatatgtcattagtcgtattat

SEQ ID NO: 230590 - DNA, 22 bp, Artificial sequence
  SiRNA target sequence
atatgtcattagtcgtattatt

SEQ ID NO: 230591 - DNA, 22 bp, Artificial sequence
  SiRNA target sequence
tatgtcattagtcgtattattt

SEQ ID NO: 230592 - DNA, 22 bp, Artificial sequence
  SiRNA target sequence
atgtcattagtcgtattatttt

SEQ ID NO: 230593 - DNA, 22 bp, Artificial sequence
  SiRNA target sequence
tgtcattagtcgtattatttta

SEQ ID NO: 230594 - DNA, 22 bp, Artificial sequence
  SiRNA target sequence
gtcattagtcgtattattttat

SEQ ID NO: 230595 - DNA, 22 bp, Artificial sequence
  SiRNA target sequence
tcattagtcgtattattttatg

SEQ ID NO: 230596 - DNA, 22 bp, Artificial sequence
  SiRNA target sequence
cattagtcgtattattttatgc

SEQ ID NO: 230597 - DNA, 22 bp, Artificial sequence
  SiRNA target sequence
attagtcgtattattttatgct

SEQ ID NO: 230598 - DNA, 22 bp, Artificial sequence
  SiRNA target sequence
ttagtcgtattattttatgctg

SEQ ID NO: 230599 - DNA, 22 bp, Artificial sequence
  SiRNA target sequence
tagtcgtattattttatgctgt

SEQ ID NO: 230600 - DNA, 22 bp, Artificial sequence
  SiRNA target sequence
agtcgtattattttatgctgtt

SEQ ID NO: 230601 - DNA, 22 bp, Artificial sequence
  SiRNA target sequence
gtcgtattattttatgctgttt

SEQ ID NO: 230602 - DNA, 22 bp, Artificial sequence
  SiRNA target sequence
tcgtattattttatgctgtttc

SEQ ID NO: 230603 - DNA, 22 bp, Artificial sequence
  SiRNA target sequence
cgtattattttatgctgtttct

SEQ ID NO: 230604 - DNA, 22 bp, Artificial sequence
  SiRNA target sequence
gtattattttatgctgtttcta

SEQ ID NO: 230605 - DNA, 22 bp, Artificial sequence
  SiRNA target sequence
tattattttatgctgtttctac

SEQ ID NO: 230606 - DNA, 22 bp, Artificial sequence
  SiRNA target sequence
attattttatgctgtttctacg

SEQ ID NO: 230607 - DNA, 22 bp, Artificial sequence
  SiRNA target sequence
ttattttatgctgtttctacga

SEQ ID NO: 230608 - DNA, 22 bp, Artificial sequence
  SiRNA target sequence
tattttatgctgtttctacgaa

SEQ ID NO: 230609 - DNA, 22 bp, Artificial sequence
  SiRNA target sequence
attttatgctgtttctacgaat

SEQ ID NO: 230610 - DNA, 22 bp, Artificial sequence
  SiRNA target sequence
ttttatgctgtttctacgaata

SEQ ID NO: 230611 - DNA, 22 bp, Artificial sequence
  SiRNA target sequence
tttatgctgtttctacgaatat

SEQ ID NO: 230612 - DNA, 22 bp, Artificial sequence
  SiRNA target sequence
ttatgctgtttctacgaatatt

SEQ ID NO: 230613 - DNA, 22 bp, Artificial sequence
  SiRNA target sequence
tatgctgtttctacgaatatta

SEQ ID NO: 230614 - DNA, 22 bp, Artificial sequence
  SiRNA target sequence
atgctgtttctacgaatattat

SEQ ID NO: 230615 - DNA, 22 bp, Artificial sequence
  SiRNA target sequence
tgctgtttctacgaatattatt

SEQ ID NO: 230616 - DNA, 22 bp, Artificial sequence
  SiRNA target sequence
gctgtttctacgaatattattg

SEQ ID NO: 230617 - DNA, 22 bp, Artificial sequence
  SiRNA target sequence
ctgtttctacgaatattattga

SEQ ID NO: 230618 - DNA, 22 bp, Artificial sequence
  SiRNA target sequence
tgtttctacgaatattattgag

SEQ ID NO: 230619 - DNA, 22 bp, Artificial sequence
  SiRNA target sequence
gtttctacgaatattattgagt

SEQ ID NO: 230620 - DNA, 22 bp, Artificial sequence
  SiRNA target sequence
tttctacgaatattattgagtc

SEQ ID NO: 230621 - DNA, 22 bp, Artificial sequence
  SiRNA target sequence
ttctacgaatattattgagtca

SEQ ID NO: 230622 - DNA, 22 bp, Artificial sequence
  SiRNA target sequence
tctacgaatattattgagtcag

SEQ ID NO: 230623 - DNA, 22 bp, Artificial sequence
  SiRNA target sequence
ctacgaatattattgagtcagc

SEQ ID NO: 230624 - DNA, 22 bp, Artificial sequence
  SiRNA target sequence
tacgaatattattgagtcagct

SEQ ID NO: 230625 - DNA, 22 bp, Artificial sequence
  SiRNA target sequence
acgaatattattgagtcagctt

SEQ ID NO: 230626 - DNA, 22 bp, Artificial sequence
  SiRNA target sequence
cgaatattattgagtcagctta

SEQ ID NO: 230627 - DNA, 22 bp, Artificial sequence
  SiRNA target sequence
gaatattattgagtcagcttat

SEQ ID NO: 230628 - DNA, 22 bp, Artificial sequence
  SiRNA target sequence
aatattattgagtcagcttata

SEQ ID NO: 230629 - DNA, 22 bp, Artificial sequence
  SiRNA target sequence
atattattgagtcagcttataa

SEQ ID NO: 230630 - DNA, 22 bp, Artificial sequence
  SiRNA target sequence
tattattgagtcagcttataaa

SEQ ID NO: 230631 - DNA, 22 bp, Artificial sequence
  SiRNA target sequence
attattgagtcagcttataaat

SEQ ID NO: 230632 - DNA, 22 bp, Artificial sequence
  SiRNA target sequence
ttattgagtcagcttataaatc

SEQ ID NO: 230633 - DNA, 22 bp, Artificial sequence
  SiRNA target sequence
tattgagtcagcttataaatct

SEQ ID NO: 230634 - DNA, 22 bp, Artificial sequence
  SiRNA target sequence
attgagtcagcttataaatctg

SEQ ID NO: 230635 - DNA, 22 bp, Artificial sequence
  SiRNA target sequence
ttgagtcagcttataaatctgc

SEQ ID NO: 230636 - DNA, 22 bp, Artificial sequence
  SiRNA target sequence
tgagtcagcttataaatctgct

SEQ ID NO: 230637 - DNA, 22 bp, Artificial sequence
  SiRNA target sequence
gagtcagcttataaatctgctt

SEQ ID NO: 230638 - DNA, 22 bp, Artificial sequence
  SiRNA target sequence
agtcagcttataaatctgcttt

SEQ ID NO: 230639 - DNA, 22 bp, Artificial sequence
  SiRNA target sequence
gtcagcttataaatctgcttta

SEQ ID NO: 230640 - DNA, 22 bp, Artificial sequence
  SiRNA target sequence
tcagcttataaatctgctttag

SEQ ID NO: 230641 - DNA, 22 bp, Artificial sequence
  SiRNA target sequence
cagcttataaatctgctttagc

SEQ ID NO: 230642 - DNA, 22 bp, Artificial sequence
  SiRNA target sequence
agcttataaatctgctttagct

SEQ ID NO: 230643 - DNA, 22 bp, Artificial sequence
  SiRNA target sequence
gcttataaatctgctttagctg

SEQ ID NO: 230644 - DNA, 22 bp, Artificial sequence
  SiRNA target sequence
cttataaatctgctttagctgt

SEQ ID NO: 230645 - DNA, 22 bp, Artificial sequence
  SiRNA target sequence
ttataaatctgctttagctgtc

SEQ ID NO: 230646 - DNA, 22 bp, Artificial sequence
  SiRNA target sequence
tataaatctgctttagctgtcg

SEQ ID NO: 230647 - DNA, 22 bp, Artificial sequence
  SiRNA target sequence
ataaatctgctttagctgtcgg

SEQ ID NO: 230648 - DNA, 22 bp, Artificial sequence
  SiRNA target sequence
taaatctgctttagctgtcggt

SEQ ID NO: 230649 - DNA, 22 bp, Artificial sequence
  SiRNA target sequence
aaatctgctttagctgtcggtg

SEQ ID NO: 230650 - DNA, 22 bp, Artificial sequence
  SiRNA target sequence
aatctgctttagctgtcggtgc

SEQ ID NO: 230651 - DNA, 22 bp, Artificial sequence
  SiRNA target sequence
atctgctttagctgtcggtgct

SEQ ID NO: 230652 - DNA, 22 bp, Artificial sequence
  SiRNA target sequence
tctgctttagctgtcggtgcta

SEQ ID NO: 230653 - DNA, 22 bp, Artificial sequence
  SiRNA target sequence
ctgctttagctgtcggtgctaa

SEQ ID NO: 230654 - DNA, 22 bp, Artificial sequence
  SiRNA target sequence
tgctttagctgtcggtgctaat

SEQ ID NO: 230655 - DNA, 22 bp, Artificial sequence
  SiRNA target sequence
gctttagctgtcggtgctaatg

SEQ ID NO: 230656 - DNA, 22 bp, Artificial sequence
  SiRNA target sequence
ctttagctgtcggtgctaatga

SEQ ID NO: 230657 - DNA, 22 bp, Artificial sequence
  SiRNA target sequence
tttagctgtcggtgctaatgaa

SEQ ID NO: 230658 - DNA, 22 bp, Artificial sequence
  SiRNA target sequence
ttagctgtcggtgctaatgaaa

SEQ ID NO: 230659 - DNA, 22 bp, Artificial sequence
  SiRNA target sequence
tagctgtcggtgctaatgaaac

SEQ ID NO: 230660 - DNA, 22 bp, Artificial sequence
  SiRNA target sequence
agctgtcggtgctaatgaaact

SEQ ID NO: 230661 - DNA, 22 bp, Artificial sequence
  SiRNA target sequence
gctgtcggtgctaatgaaactg

SEQ ID NO: 230662 - DNA, 22 bp, Artificial sequence
  SiRNA target sequence
ctgtcggtgctaatgaaactgg

SEQ ID NO: 230663 - DNA, 22 bp, Artificial sequence
  SiRNA target sequence
tgtcggtgctaatgaaactggt

SEQ ID NO: 230664 - DNA, 22 bp, Artificial sequence
  SiRNA target sequence
gtcggtgctaatgaaactggtg

SEQ ID NO: 230665 - DNA, 22 bp, Artificial sequence
  SiRNA target sequence
tcggtgctaatgaaactggtga

SEQ ID NO: 230666 - DNA, 22 bp, Artificial sequence
  SiRNA target sequence
cggtgctaatgaaactggtgag

SEQ ID NO: 230667 - DNA, 22 bp, Artificial sequence
  SiRNA target sequence
ggtgctaatgaaactggtgagg

SEQ ID NO: 230668 - DNA, 22 bp, Artificial sequence
  SiRNA target sequence
gtgctaatgaaactggtgaggc

SEQ ID NO: 230669 - DNA, 22 bp, Artificial sequence
  SiRNA target sequence
tgctaatgaaactggtgaggca

SEQ ID NO: 230670 - DNA, 22 bp, Artificial sequence
  SiRNA target sequence
gctaatgaaactggtgaggcaa

SEQ ID NO: 230671 - DNA, 22 bp, Artificial sequence
  SiRNA target sequence
ctaatgaaactggtgaggcaaa

SEQ ID NO: 230672 - DNA, 22 bp, Artificial sequence
  SiRNA target sequence
taatgaaactggtgaggcaaaa

SEQ ID NO: 230673 - DNA, 22 bp, Artificial sequence
  SiRNA target sequence
aatgaaactggtgaggcaaaat

SEQ ID NO: 230674 - DNA, 22 bp, Artificial sequence
  SiRNA target sequence
atgaaactggtgaggcaaaatc

SEQ ID NO: 230675 - DNA, 22 bp, Artificial sequence
  SiRNA target sequence
tgaaactggtgaggcaaaatct

SEQ ID NO: 230676 - DNA, 22 bp, Artificial sequence
  SiRNA target sequence
gaaactggtgaggcaaaatcta

SEQ ID NO: 230677 - DNA, 22 bp, Artificial sequence
  SiRNA target sequence
aaactggtgaggcaaaatctac

SEQ ID NO: 230678 - DNA, 22 bp, Artificial sequence
  SiRNA target sequence
aactggtgaggcaaaatctacc

SEQ ID NO: 230679 - DNA, 22 bp, Artificial sequence
  SiRNA target sequence
actggtgaggcaaaatctacct

SEQ ID NO: 230680 - DNA, 22 bp, Artificial sequence
  SiRNA target sequence
ctggtgaggcaaaatctaccta

SEQ ID NO: 230681 - DNA, 22 bp, Artificial sequence
  SiRNA target sequence
tggtgaggcaaaatctacctat

SEQ ID NO: 230682 - DNA, 22 bp, Artificial sequence
  SiRNA target sequence
ggtgaggcaaaatctacctatg

SEQ ID NO: 230683 - DNA, 22 bp, Artificial sequence
  SiRNA target sequence
gtgaggcaaaatctacctatgc

SEQ ID NO: 230684 - DNA, 22 bp, Artificial sequence
  SiRNA target sequence
tgaggcaaaatctacctatgct

SEQ ID NO: 230685 - DNA, 22 bp, Artificial sequence
  SiRNA target sequence
gaggcaaaatctacctatgctt

SEQ ID NO: 230686 - DNA, 22 bp, Artificial sequence
  SiRNA target sequence
aggcaaaatctacctatgcttc

SEQ ID NO: 230687 - DNA, 22 bp, Artificial sequence
  SiRNA target sequence
ggcaaaatctacctatgcttca

SEQ ID NO: 230688 - DNA, 22 bp, Artificial sequence
  SiRNA target sequence
gcaaaatctacctatgcttcaa

SEQ ID NO: 230689 - DNA, 22 bp, Artificial sequence
  SiRNA target sequence
caaaatctacctatgcttcaat

SEQ ID NO: 230690 - DNA, 22 bp, Artificial sequence
  SiRNA target sequence
aaaatctacctatgcttcaatt

SEQ ID NO: 230691 - DNA, 22 bp, Artificial sequence
  SiRNA target sequence
aaatctacctatgcttcaattt

SEQ ID NO: 230692 - DNA, 22 bp, Artificial sequence
  SiRNA target sequence
aatctacctatgcttcaattta

SEQ ID NO: 230693 - DNA, 22 bp, Artificial sequence
  SiRNA target sequence
atctacctatgcttcaatttat

SEQ ID NO: 230694 - DNA, 22 bp, Artificial sequence
  SiRNA target sequence
tctacctatgcttcaatttata

SEQ ID NO: 230695 - DNA, 22 bp, Artificial sequence
  SiRNA target sequence
ctacctatgcttcaatttatac

SEQ ID NO: 230696 - DNA, 22 bp, Artificial sequence
  SiRNA target sequence
tacctatgcttcaatttataca

SEQ ID NO: 230697 - DNA, 22 bp, Artificial sequence
  SiRNA target sequence
acctatgcttcaatttatacat

SEQ ID NO: 230698 - DNA, 22 bp, Artificial sequence
  SiRNA target sequence
cctatgcttcaatttatacatc

SEQ ID NO: 230699 - DNA, 22 bp, Artificial sequence
  SiRNA target sequence
ctatgcttcaatttatacatca

SEQ ID NO: 230700 - DNA, 22 bp, Artificial sequence
  SiRNA target sequence
tatgcttcaatttatacatcaa

SEQ ID NO: 230701 - DNA, 22 bp, Artificial sequence
  SiRNA target sequence
atgcttcaatttatacatcaat

SEQ ID NO: 230702 - DNA, 22 bp, Artificial sequence
  SiRNA target sequence
tgcttcaatttatacatcaatt

SEQ ID NO: 230703 - DNA, 22 bp, Artificial sequence
  SiRNA target sequence
gcttcaatttatacatcaattg

SEQ ID NO: 230704 - DNA, 22 bp, Artificial sequence
  SiRNA target sequence
cttcaatttatacatcaattga

SEQ ID NO: 230705 - DNA, 22 bp, Artificial sequence
  SiRNA target sequence
ttcaatttatacatcaattgaa

SEQ ID NO: 230706 - DNA, 22 bp, Artificial sequence
  SiRNA target sequence
tcaatttatacatcaattgaac

SEQ ID NO: 230707 - DNA, 22 bp, Artificial sequence
  SiRNA target sequence
caatttatacatcaattgaaca

SEQ ID NO: 230708 - DNA, 22 bp, Artificial sequence
  SiRNA target sequence
aatttatacatcaattgaacaa

SEQ ID NO: 230709 - DNA, 22 bp, Artificial sequence
  SiRNA target sequence
atttatacatcaattgaacaat

SEQ ID NO: 230710 - DNA, 22 bp, Artificial sequence
  SiRNA target sequence
tttatacatcaattgaacaatc

SEQ ID NO: 230711 - DNA, 22 bp, Artificial sequence
  SiRNA target sequence
ttatacatcaattgaacaatct

SEQ ID NO: 230712 - DNA, 22 bp, Artificial sequence
  SiRNA target sequence
tatacatcaattgaacaatctg

SEQ ID NO: 230713 - DNA, 22 bp, Artificial sequence
  SiRNA target sequence
atacatcaattgaacaatctgg

SEQ ID NO: 230714 - DNA, 22 bp, Artificial sequence
  SiRNA target sequence
tacatcaattgaacaatctgga

SEQ ID NO: 230715 - DNA, 22 bp, Artificial sequence
  SiRNA target sequence
acatcaattgaacaatctggag

SEQ ID NO: 230716 - DNA, 22 bp, Artificial sequence
  SiRNA target sequence
catcaattgaacaatctggagt

SEQ ID NO: 230717 - DNA, 22 bp, Artificial sequence
  SiRNA target sequence
atcaattgaacaatctggagtt

SEQ ID NO: 230718 - DNA, 22 bp, Artificial sequence
  SiRNA target sequence
tcaattgaacaatctggagttg

SEQ ID NO: 230719 - DNA, 22 bp, Artificial sequence
  SiRNA target sequence
caattgaacaatctggagttgc

SEQ ID NO: 230720 - DNA, 22 bp, Artificial sequence
  SiRNA target sequence
aattgaacaatctggagttgct

SEQ ID NO: 230721 - DNA, 22 bp, Artificial sequence
  SiRNA target sequence
attgaacaatctggagttgctg

SEQ ID NO: 230722 - DNA, 22 bp, Artificial sequence
  SiRNA target sequence
ttgaacaatctggagttgctgt

SEQ ID NO: 230723 - DNA, 22 bp, Artificial sequence
  SiRNA target sequence
tgaacaatctggagttgctgtt

SEQ ID NO: 230724 - DNA, 22 bp, Artificial sequence
  SiRNA target sequence
gaacaatctggagttgctgtta

SEQ ID NO: 230725 - DNA, 22 bp, Artificial sequence
  SiRNA target sequence
aacaatctggagttgctgttat

SEQ ID NO: 230726 - DNA, 22 bp, Artificial sequence
  SiRNA target sequence
acaatctggagttgctgttatt

SEQ ID NO: 230727 - DNA, 22 bp, Artificial sequence
  SiRNA target sequence
caatctggagttgctgttattg

SEQ ID NO: 230728 - DNA, 22 bp, Artificial sequence
  SiRNA target sequence
aatctggagttgctgttattgt

SEQ ID NO: 230729 - DNA, 22 bp, Artificial sequence
  SiRNA target sequence
atctggagttgctgttattgtc

SEQ ID NO: 230730 - DNA, 22 bp, Artificial sequence
  SiRNA target sequence
tctggagttgctgttattgtca

SEQ ID NO: 230731 - DNA, 22 bp, Artificial sequence
  SiRNA target sequence
ctggagttgctgttattgtcat

SEQ ID NO: 230732 - DNA, 22 bp, Artificial sequence
  SiRNA target sequence
tggagttgctgttattgtcatg

SEQ ID NO: 230733 - DNA, 22 bp, Artificial sequence
  SiRNA target sequence
ggagttgctgttattgtcatga

SEQ ID NO: 230734 - DNA, 22 bp, Artificial sequence
  SiRNA target sequence
gagttgctgttattgtcatgat

SEQ ID NO: 230735 - DNA, 22 bp, Artificial sequence
  SiRNA target sequence
agttgctgttattgtcatgatt

SEQ ID NO: 230736 - DNA, 22 bp, Artificial sequence
  SiRNA target sequence
gttgctgttattgtcatgattt

SEQ ID NO: 230737 - DNA, 22 bp, Artificial sequence
  SiRNA target sequence
ttgctgttattgtcatgatttt

SEQ ID NO: 230738 - DNA, 22 bp, Artificial sequence
  SiRNA target sequence
tgctgttattgtcatgattttg

SEQ ID NO: 230739 - DNA, 22 bp, Artificial sequence
  SiRNA target sequence
gctgttattgtcatgattttgc

SEQ ID NO: 230740 - DNA, 22 bp, Artificial sequence
  SiRNA target sequence
ctgttattgtcatgattttgct

SEQ ID NO: 230741 - DNA, 22 bp, Artificial sequence
  SiRNA target sequence
tgttattgtcatgattttgcta

SEQ ID NO: 230742 - DNA, 22 bp, Artificial sequence
  SiRNA target sequence
gttattgtcatgattttgctac

SEQ ID NO: 230743 - DNA, 22 bp, Artificial sequence
  SiRNA target sequence
ttattgtcatgattttgctact

SEQ ID NO: 230744 - DNA, 22 bp, Artificial sequence
  SiRNA target sequence
tattgtcatgattttgctactt

SEQ ID NO: 230745 - DNA, 22 bp, Artificial sequence
  SiRNA target sequence
attgtcatgattttgctactta

SEQ ID NO: 230746 - DNA, 22 bp, Artificial sequence
  SiRNA target sequence
ttgtcatgattttgctacttac

SEQ ID NO: 230747 - DNA, 22 bp, Artificial sequence
  SiRNA target sequence
tgtcatgattttgctacttacc

SEQ ID NO: 230748 - DNA, 22 bp, Artificial sequence
  SiRNA target sequence
gtcatgattttgctacttaccc

SEQ ID NO: 230749 - DNA, 22 bp, Artificial sequence
  SiRNA target sequence
tcatgattttgctacttacccc

SEQ ID NO: 230750 - DNA, 22 bp, Artificial sequence
  SiRNA target sequence
catgattttgctacttacccct

SEQ ID NO: 230751 - DNA, 22 bp, Artificial sequence
  SiRNA target sequence
atgattttgctacttacccctt

SEQ ID NO: 230752 - DNA, 22 bp, Artificial sequence
  SiRNA target sequence
tgattttgctacttaccccttt

SEQ ID NO: 230753 - DNA, 22 bp, Artificial sequence
  SiRNA target sequence
gattttgctacttacccctttt

SEQ ID NO: 230754 - DNA, 22 bp, Artificial sequence
  SiRNA target sequence
attttgctacttaccccttttc

SEQ ID NO: 230755 - DNA, 22 bp, Artificial sequence
  SiRNA target sequence
ttttgctacttaccccttttcc

SEQ ID NO: 230756 - DNA, 22 bp, Artificial sequence
  SiRNA target sequence
tttgctacttaccccttttcca

SEQ ID NO: 230757 - DNA, 22 bp, Artificial sequence
  SiRNA target sequence
ttgctacttaccccttttccaa

SEQ ID NO: 230758 - DNA, 22 bp, Artificial sequence
  SiRNA target sequence
tgctacttaccccttttccaag

SEQ ID NO: 230759 - DNA, 22 bp, Artificial sequence
  SiRNA target sequence
gctacttaccccttttccaagg

SEQ ID NO: 230760 - DNA, 22 bp, Artificial sequence
  SiRNA target sequence
ctacttaccccttttccaaggc

SEQ ID NO: 230761 - DNA, 22 bp, Artificial sequence
  SiRNA target sequence
tacttaccccttttccaaggct

SEQ ID NO: 230762 - DNA, 22 bp, Artificial sequence
  SiRNA target sequence
acttaccccttttccaaggctt

SEQ ID NO: 230763 - DNA, 22 bp, Artificial sequence
  SiRNA target sequence
cttaccccttttccaaggctta

SEQ ID NO: 230764 - DNA, 22 bp, Artificial sequence
  SiRNA target sequence
ttaccccttttccaaggcttat

SEQ ID NO: 230765 - DNA, 22 bp, Artificial sequence
  SiRNA target sequence
taccccttttccaaggcttatt

SEQ ID NO: 230766 - DNA, 22 bp, Artificial sequence
  SiRNA target sequence
accccttttccaaggcttatta

SEQ ID NO: 230767 - DNA, 22 bp, Artificial sequence
  SiRNA target sequence
ccccttttccaaggcttattaa

SEQ ID NO: 230768 - DNA, 22 bp, Artificial sequence
  SiRNA target sequence
cccttttccaaggcttattaaa

SEQ ID NO: 230769 - DNA, 22 bp, Artificial sequence
  SiRNA target sequence
ccttttccaaggcttattaaaa

SEQ ID NO: 230770 - DNA, 22 bp, Artificial sequence
  SiRNA target sequence
cttttccaaggcttattaaaac

SEQ ID NO: 230771 - DNA, 22 bp, Artificial sequence
  SiRNA target sequence
ttttccaaggcttattaaaaca

SEQ ID NO: 230772 - DNA, 22 bp, Artificial sequence
  SiRNA target sequence
tttccaaggcttattaaaacaa

SEQ ID NO: 230773 - DNA, 22 bp, Artificial sequence
  SiRNA target sequence
ttccaaggcttattaaaacaaa

SEQ ID NO: 230774 - DNA, 22 bp, Artificial sequence
  SiRNA target sequence
tccaaggcttattaaaacaaaa

SEQ ID NO: 230775 - DNA, 22 bp, Artificial sequence
  SiRNA target sequence
ccaaggcttattaaaacaaaag

SEQ ID NO: 230776 - DNA, 22 bp, Artificial sequence
  SiRNA target sequence
caaggcttattaaaacaaaagg

SEQ ID NO: 230777 - DNA, 22 bp, Artificial sequence
  SiRNA target sequence
aaggcttattaaaacaaaagga

SEQ ID NO: 230778 - DNA, 22 bp, Artificial sequence
  SiRNA target sequence
aggcttattaaaacaaaaggat

SEQ ID NO: 230779 - DNA, 22 bp, Artificial sequence
  SiRNA target sequence
ggcttattaaaacaaaaggatg

SEQ ID NO: 230780 - DNA, 22 bp, Artificial sequence
  SiRNA target sequence
gcttattaaaacaaaaggatgg

SEQ ID NO: 230781 - DNA, 22 bp, Artificial sequence
  SiRNA target sequence
cttattaaaacaaaaggatgga

SEQ ID NO: 230782 - DNA, 22 bp, Artificial sequence
  SiRNA target sequence
ttattaaaacaaaaggatggat

SEQ ID NO: 230783 - DNA, 22 bp, Artificial sequence
  SiRNA target sequence
tattaaaacaaaaggatggatt

SEQ ID NO: 230784 - DNA, 22 bp, Artificial sequence
  SiRNA target sequence
attaaaacaaaaggatggatta

SEQ ID NO: 230785 - DNA, 22 bp, Artificial sequence
  SiRNA target sequence
ttaaaacaaaaggatggattac

SEQ ID NO: 230786 - DNA, 22 bp, Artificial sequence
  SiRNA target sequence
taaaacaaaaggatggattaca

SEQ ID NO: 230787 - DNA, 22 bp, Artificial sequence
  SiRNA target sequence
aaaacaaaaggatggattacaa

SEQ ID NO: 230788 - DNA, 22 bp, Artificial sequence
  SiRNA target sequence
aaacaaaaggatggattacaat

SEQ ID NO: 230789 - DNA, 22 bp, Artificial sequence
  SiRNA target sequence
aacaaaaggatggattacaata

SEQ ID NO: 230790 - DNA, 22 bp, Artificial sequence
  SiRNA target sequence
acaaaaggatggattacaatag

SEQ ID NO: 230791 - DNA, 22 bp, Artificial sequence
  SiRNA target sequence
caaaaggatggattacaatagc

SEQ ID NO: 230792 - DNA, 22 bp, Artificial sequence
  SiRNA target sequence
aaaaggatggattacaatagcc

SEQ ID NO: 230793 - DNA, 22 bp, Artificial sequence
  SiRNA target sequence
aaaggatggattacaatagcca

SEQ ID NO: 230794 - DNA, 22 bp, Artificial sequence
  SiRNA target sequence
aaggatggattacaatagccat

SEQ ID NO: 230795 - DNA, 22 bp, Artificial sequence
  SiRNA target sequence
aggatggattacaatagccatt

SEQ ID NO: 230796 - DNA, 22 bp, Artificial sequence
  SiRNA target sequence
ggatggattacaatagccattc

SEQ ID NO: 230797 - DNA, 22 bp, Artificial sequence
  SiRNA target sequence
gatggattacaatagccattct

SEQ ID NO: 230798 - DNA, 22 bp, Artificial sequence
  SiRNA target sequence
atggattacaatagccattcta

SEQ ID NO: 230799 - DNA, 22 bp, Artificial sequence
  SiRNA target sequence
tggattacaatagccattctat

SEQ ID NO: 230800 - DNA, 22 bp, Artificial sequence
  SiRNA target sequence
ggattacaatagccattctatg

SEQ ID NO: 230801 - DNA, 22 bp, Artificial sequence
  SiRNA target sequence
gattacaatagccattctatgt

SEQ ID NO: 230802 - DNA, 22 bp, Artificial sequence
  SiRNA target sequence
attacaatagccattctatgtc

SEQ ID NO: 230803 - DNA, 22 bp, Artificial sequence
  SiRNA target sequence
ttacaatagccattctatgtcc

SEQ ID NO: 230804 - DNA, 22 bp, Artificial sequence
  SiRNA target sequence
tacaatagccattctatgtcct

SEQ ID NO: 230805 - DNA, 22 bp, Artificial sequence
  SiRNA target sequence
acaatagccattctatgtccta

SEQ ID NO: 230806 - DNA, 22 bp, Artificial sequence
  SiRNA target sequence
caatagccattctatgtcctat

SEQ ID NO: 230807 - DNA, 22 bp, Artificial sequence
  SiRNA target sequence
aatagccattctatgtcctatt

SEQ ID NO: 230808 - DNA, 22 bp, Artificial sequence
  SiRNA target sequence
atagccattctatgtcctatta

SEQ ID NO: 230809 - DNA, 22 bp, Artificial sequence
  SiRNA target sequence
tagccattctatgtcctattat

SEQ ID NO: 230810 - DNA, 22 bp, Artificial sequence
  SiRNA target sequence
agccattctatgtcctattatt

SEQ ID NO: 230811 - DNA, 22 bp, Artificial sequence
  SiRNA target sequence
gccattctatgtcctattatta

SEQ ID NO: 230812 - DNA, 22 bp, Artificial sequence
  SiRNA target sequence
ccattctatgtcctattattac

SEQ ID NO: 230813 - DNA, 22 bp, Artificial sequence
  SiRNA target sequence
cattctatgtcctattattact

SEQ ID NO: 230814 - DNA, 22 bp, Artificial sequence
  SiRNA target sequence
attctatgtcctattattactt

SEQ ID NO: 230815 - DNA, 22 bp, Artificial sequence
  SiRNA target sequence
ttctatgtcctattattacttt

SEQ ID NO: 230816 - DNA, 22 bp, Artificial sequence
  SiRNA target sequence
tctatgtcctattattactttt

SEQ ID NO: 230817 - DNA, 22 bp, Artificial sequence
  SiRNA target sequence
ctatgtcctattattacttttt

SEQ ID NO: 230818 - DNA, 22 bp, Artificial sequence
  SiRNA target sequence
tatgtcctattattactttttt

SEQ ID NO: 230819 - DNA, 22 bp, Artificial sequence
  SiRNA target sequence
atgtcctattattacttttttt

SEQ ID NO: 230820 - DNA, 22 bp, Artificial sequence
  SiRNA target sequence
tgtcctattattactttttttt

SEQ ID NO: 230821 - DNA, 22 bp, Artificial sequence
  SiRNA target sequence
gtcctattattacttttttttc

SEQ ID NO: 230822 - DNA, 22 bp, Artificial sequence
  SiRNA target sequence
tcctattattacttttttttct

SEQ ID NO: 230823 - DNA, 22 bp, Artificial sequence
  SiRNA target sequence
cctattattacttttttttctg

SEQ ID NO: 230824 - DNA, 22 bp, Artificial sequence
  SiRNA target sequence
ctattattacttttttttctgc

SEQ ID NO: 230825 - DNA, 22 bp, Artificial sequence
  SiRNA target sequence
tattattacttttttttctgct

SEQ ID NO: 230826 - DNA, 22 bp, Artificial sequence
  SiRNA target sequence
attattacttttttttctgctt

SEQ ID NO: 230827 - DNA, 22 bp, Artificial sequence
  SiRNA target sequence
ttattacttttttttctgcttt

SEQ ID NO: 230828 - DNA, 22 bp, Artificial sequence
  SiRNA target sequence
tattacttttttttctgctttt

SEQ ID NO: 230829 - DNA, 22 bp, Artificial sequence
  SiRNA target sequence
attacttttttttctgcttttg

SEQ ID NO: 230830 - DNA, 22 bp, Artificial sequence
  SiRNA target sequence
ttacttttttttctgcttttgg

SEQ ID NO: 230831 - DNA, 22 bp, Artificial sequence
  SiRNA target sequence
tacttttttttctgcttttggt

SEQ ID NO: 230832 - DNA, 22 bp, Artificial sequence
  SiRNA target sequence
acttttttttctgcttttggta

SEQ ID NO: 230833 - DNA, 22 bp, Artificial sequence
  SiRNA target sequence
cttttttttctgcttttggtac

SEQ ID NO: 230834 - DNA, 22 bp, Artificial sequence
  SiRNA target sequence
ttttttttctgcttttggtact

SEQ ID NO: 230835 - DNA, 22 bp, Artificial sequence
  SiRNA target sequence
tttttttctgcttttggtactt

SEQ ID NO: 230836 - DNA, 22 bp, Artificial sequence
  SiRNA target sequence
ttttttctgcttttggtacttt

SEQ ID NO: 230837 - DNA, 22 bp, Artificial sequence
  SiRNA target sequence
tttttctgcttttggtactttt

SEQ ID NO: 230838 - DNA, 22 bp, Artificial sequence
  SiRNA target sequence
ttttctgcttttggtacttttg

SEQ ID NO: 230839 - DNA, 22 bp, Artificial sequence
  SiRNA target sequence
tttctgcttttggtacttttgt

SEQ ID NO: 230840 - DNA, 22 bp, Artificial sequence
  SiRNA target sequence
ttctgcttttggtacttttgta

SEQ ID NO: 230841 - DNA, 22 bp, Artificial sequence
  SiRNA target sequence
tctgcttttggtacttttgtat

SEQ ID NO: 230842 - DNA, 22 bp, Artificial sequence
  SiRNA target sequence
ctgcttttggtacttttgtatt

SEQ ID NO: 230843 - DNA, 22 bp, Artificial sequence
  SiRNA target sequence
tgcttttggtacttttgtatta

SEQ ID NO: 230844 - DNA, 22 bp, Artificial sequence
  SiRNA target sequence
gcttttggtacttttgtattag

SEQ ID NO: 230845 - DNA, 22 bp, Artificial sequence
  SiRNA target sequence
cttttggtacttttgtattagc

SEQ ID NO: 230846 - DNA, 22 bp, Artificial sequence
  SiRNA target sequence
ttttggtacttttgtattagct

SEQ ID NO: 230847 - DNA, 22 bp, Artificial sequence
  SiRNA target sequence
tttggtacttttgtattagctt

SEQ ID NO: 230848 - DNA, 22 bp, Artificial sequence
  SiRNA target sequence
ttggtacttttgtattagctta

SEQ ID NO: 230849 - DNA, 22 bp, Artificial sequence
  SiRNA target sequence
tggtacttttgtattagcttat

SEQ ID NO: 230850 - DNA, 22 bp, Artificial sequence
  SiRNA target sequence
ggtacttttgtattagcttatt

SEQ ID NO: 230851 - DNA, 22 bp, Artificial sequence
  SiRNA target sequence
gtacttttgtattagcttattt

SEQ ID NO: 230852 - DNA, 22 bp, Artificial sequence
  SiRNA target sequence
tacttttgtattagcttattta

SEQ ID NO: 230853 - DNA, 22 bp, Artificial sequence
  SiRNA target sequence
acttttgtattagcttatttaa

SEQ ID NO: 230854 - DNA, 22 bp, Artificial sequence
  SiRNA target sequence
cttttgtattagcttatttaaa

SEQ ID NO: 230855 - DNA, 22 bp, Artificial sequence
  SiRNA target sequence
ttttgtattagcttatttaaac

SEQ ID NO: 230856 - DNA, 22 bp, Artificial sequence
  SiRNA target sequence
tttgtattagcttatttaaact

SEQ ID NO: 230857 - DNA, 22 bp, Artificial sequence
  SiRNA target sequence
ttgtattagcttatttaaactt

SEQ ID NO: 230858 - DNA, 22 bp, Artificial sequence
  SiRNA target sequence
tgtattagcttatttaaacttc

SEQ ID NO: 230859 - DNA, 22 bp, Artificial sequence
  SiRNA target sequence
gtattagcttatttaaacttcc

SEQ ID NO: 230860 - DNA, 22 bp, Artificial sequence
  SiRNA target sequence
tattagcttatttaaacttccc

SEQ ID NO: 230861 - DNA, 22 bp, Artificial sequence
  SiRNA target sequence
attagcttatttaaacttccca

SEQ ID NO: 230862 - DNA, 22 bp, Artificial sequence
  SiRNA target sequence
ttagcttatttaaacttcccaa

SEQ ID NO: 230863 - DNA, 22 bp, Artificial sequence
  SiRNA target sequence
tagcttatttaaacttcccaat

SEQ ID NO: 230864 - DNA, 22 bp, Artificial sequence
  SiRNA target sequence
agcttatttaaacttcccaatt

SEQ ID NO: 230865 - DNA, 22 bp, Artificial sequence
  SiRNA target sequence
gcttatttaaacttcccaatta

SEQ ID NO: 230866 - DNA, 22 bp, Artificial sequence
  SiRNA target sequence
cttatttaaacttcccaattac

SEQ ID NO: 230867 - DNA, 22 bp, Artificial sequence
  SiRNA target sequence
ttatttaaacttcccaattaca

SEQ ID NO: 230868 - DNA, 22 bp, Artificial sequence
  SiRNA target sequence
tatttaaacttcccaattacaa

SEQ ID NO: 230869 - DNA, 22 bp, Artificial sequence
  SiRNA target sequence
atttaaacttcccaattacaaa

SEQ ID NO: 230870 - DNA, 22 bp, Artificial sequence
  SiRNA target sequence
tttaaacttcccaattacaaac

SEQ ID NO: 230871 - DNA, 22 bp, Artificial sequence
  SiRNA target sequence
ttaaacttcccaattacaaaca

SEQ ID NO: 230872 - DNA, 22 bp, Artificial sequence
  SiRNA target sequence
taaacttcccaattacaaacaa

SEQ ID NO: 230873 - DNA, 22 bp, Artificial sequence
  SiRNA target sequence
aaacttcccaattacaaacaaa

SEQ ID NO: 230874 - DNA, 22 bp, Artificial sequence
  SiRNA target sequence
aacttcccaattacaaacaaag

SEQ ID NO: 230875 - DNA, 22 bp, Artificial sequence
  SiRNA target sequence
acttcccaattacaaacaaaga

SEQ ID NO: 230876 - DNA, 22 bp, Artificial sequence
  SiRNA target sequence
cttcccaattacaaacaaagag

SEQ ID NO: 230877 - DNA, 22 bp, Artificial sequence
  SiRNA target sequence
ttcccaattacaaacaaagagg

SEQ ID NO: 230878 - DNA, 22 bp, Artificial sequence
  SiRNA target sequence
tcccaattacaaacaaagagga

SEQ ID NO: 230879 - DNA, 22 bp, Artificial sequence
  SiRNA target sequence
cccaattacaaacaaagaggat

SEQ ID NO: 230880 - DNA, 22 bp, Artificial sequence
  SiRNA target sequence
ccaattacaaacaaagaggata

SEQ ID NO: 230881 - DNA, 22 bp, Artificial sequence
  SiRNA target sequence
caattacaaacaaagaggataa

SEQ ID NO: 230882 - DNA, 22 bp, Artificial sequence
  SiRNA target sequence
aattacaaacaaagaggataat

SEQ ID NO: 230883 - DNA, 22 bp, Artificial sequence
  SiRNA target sequence
attacaaacaaagaggataata

SEQ ID NO: 230884 - DNA, 22 bp, Artificial sequence
  SiRNA target sequence
ttacaaacaaagaggataatat

SEQ ID NO: 230885 - DNA, 22 bp, Artificial sequence
  SiRNA target sequence
tacaaacaaagaggataatata

SEQ ID NO: 230886 - DNA, 22 bp, Artificial sequence
  SiRNA target sequence
acaaacaaagaggataatatat

SEQ ID NO: 230887 - DNA, 22 bp, Artificial sequence
  SiRNA target sequence
caaacaaagaggataatatatt

SEQ ID NO: 230888 - DNA, 22 bp, Artificial sequence
  SiRNA target sequence
aaacaaagaggataatatattt

SEQ ID NO: 230889 - DNA, 22 bp, Artificial sequence
  SiRNA target sequence
aacaaagaggataatatatttg

SEQ ID NO: 230890 - DNA, 22 bp, Artificial sequence
  SiRNA target sequence
acaaagaggataatatatttga

SEQ ID NO: 230891 - DNA, 22 bp, Artificial sequence
  SiRNA target sequence
caaagaggataatatatttgat

SEQ ID NO: 230892 - DNA, 22 bp, Artificial sequence
  SiRNA target sequence
aaagaggataatatatttgata

SEQ ID NO: 230893 - DNA, 22 bp, Artificial sequence
  SiRNA target sequence
aagaggataatatatttgatat

SEQ ID NO: 230894 - DNA, 22 bp, Artificial sequence
  SiRNA target sequence
agaggataatatatttgatatt

SEQ ID NO: 230895 - DNA, 22 bp, Artificial sequence
  SiRNA target sequence
gaggataatatatttgatattt

SEQ ID NO: 230896 - DNA, 22 bp, Artificial sequence
  SiRNA target sequence
aggataatatatttgatattta

SEQ ID NO: 230897 - DNA, 22 bp, Artificial sequence
  SiRNA target sequence
ggataatatatttgatatttac

SEQ ID NO: 230898 - DNA, 22 bp, Artificial sequence
  SiRNA target sequence
gataatatatttgatatttacc

SEQ ID NO: 230899 - DNA, 22 bp, Artificial sequence
  SiRNA target sequence
ataatatatttgatatttaccg

SEQ ID NO: 230900 - DNA, 22 bp, Artificial sequence
  SiRNA target sequence
taatatatttgatatttaccgt

SEQ ID NO: 230901 - DNA, 22 bp, Artificial sequence
  SiRNA target sequence
aatatatttgatatttaccgtt

SEQ ID NO: 230902 - DNA, 22 bp, Artificial sequence
  SiRNA target sequence
atatatttgatatttaccgttt

SEQ ID NO: 230903 - DNA, 22 bp, Artificial sequence
  SiRNA target sequence
tatatttgatatttaccgttta

SEQ ID NO: 230904 - DNA, 22 bp, Artificial sequence
  SiRNA target sequence
atatttgatatttaccgtttac

SEQ ID NO: 230905 - DNA, 22 bp, Artificial sequence
  SiRNA target sequence
tatttgatatttaccgtttacc

SEQ ID NO: 230906 - DNA, 22 bp, Artificial sequence
  SiRNA target sequence
atttgatatttaccgtttaccg

SEQ ID NO: 230907 - DNA, 22 bp, Artificial sequence
  SiRNA target sequence
tttgatatttaccgtttaccgt

SEQ ID NO: 230908 - DNA, 22 bp, Artificial sequence
  SiRNA target sequence
ttgatatttaccgtttaccgtc

SEQ ID NO: 230909 - DNA, 22 bp, Artificial sequence
  SiRNA target sequence
tgatatttaccgtttaccgtca

SEQ ID NO: 230910 - DNA, 22 bp, Artificial sequence
  SiRNA target sequence
gatatttaccgtttaccgtcaa

SEQ ID NO: 230911 - DNA, 22 bp, Artificial sequence
  SiRNA target sequence
atatttaccgtttaccgtcaac

SEQ ID NO: 230912 - DNA, 22 bp, Artificial sequence
  SiRNA target sequence
tatttaccgtttaccgtcaact

SEQ ID NO: 230913 - DNA, 22 bp, Artificial sequence
  SiRNA target sequence
atttaccgtttaccgtcaactg

SEQ ID NO: 230914 - DNA, 22 bp, Artificial sequence
  SiRNA target sequence
tttaccgtttaccgtcaactga

SEQ ID NO: 230915 - DNA, 22 bp, Artificial sequence
  SiRNA target sequence
ttaccgtttaccgtcaactgat

SEQ ID NO: 230916 - DNA, 22 bp, Artificial sequence
  SiRNA target sequence
taccgtttaccgtcaactgatt

SEQ ID NO: 230917 - DNA, 22 bp, Artificial sequence
  SiRNA target sequence
accgtttaccgtcaactgattc

SEQ ID NO: 230918 - DNA, 22 bp, Artificial sequence
  SiRNA target sequence
ccgtttaccgtcaactgattct

SEQ ID NO: 230919 - DNA, 22 bp, Artificial sequence
  SiRNA target sequence
cgtttaccgtcaactgattcta

SEQ ID NO: 230920 - DNA, 22 bp, Artificial sequence
  SiRNA target sequence
gtttaccgtcaactgattctat

SEQ ID NO: 230921 - DNA, 22 bp, Artificial sequence
  SiRNA target sequence
tttaccgtcaactgattctata

SEQ ID NO: 230922 - DNA, 22 bp, Artificial sequence
  SiRNA target sequence
ttaccgtcaactgattctataa

SEQ ID NO: 230923 - DNA, 22 bp, Artificial sequence
  SiRNA target sequence
taccgtcaactgattctataat

SEQ ID NO: 230924 - DNA, 22 bp, Artificial sequence
  SiRNA target sequence
accgtcaactgattctataatc

SEQ ID NO: 230925 - DNA, 22 bp, Artificial sequence
  SiRNA target sequence
ccgtcaactgattctataatca

SEQ ID NO: 230926 - DNA, 22 bp, Artificial sequence
  SiRNA target sequence
cgtcaactgattctataatcaa

SEQ ID NO: 230927 - DNA, 22 bp, Artificial sequence
  SiRNA target sequence
gtcaactgattctataatcaaa

SEQ ID NO: 230928 - DNA, 22 bp, Artificial sequence
  SiRNA target sequence
tcaactgattctataatcaaat

SEQ ID NO: 230929 - DNA, 22 bp, Artificial sequence
  SiRNA target sequence
caactgattctataatcaaatt

SEQ ID NO: 230930 - DNA, 22 bp, Artificial sequence
  SiRNA target sequence
aactgattctataatcaaatta

SEQ ID NO: 230931 - DNA, 22 bp, Artificial sequence
  SiRNA target sequence
actgattctataatcaaattag

SEQ ID NO: 230932 - DNA, 22 bp, Artificial sequence
  SiRNA target sequence
ctgattctataatcaaattaga

SEQ ID NO: 230933 - DNA, 22 bp, Artificial sequence
  SiRNA target sequence
tgattctataatcaaattagaa

SEQ ID NO: 230934 - DNA, 22 bp, Artificial sequence
  SiRNA target sequence
gattctataatcaaattagaaa

SEQ ID NO: 230935 - DNA, 22 bp, Artificial sequence
  SiRNA target sequence
attctataatcaaattagaaaa

SEQ ID NO: 230936 - DNA, 22 bp, Artificial sequence
  SiRNA target sequence
ttctataatcaaattagaaaat

SEQ ID NO: 230937 - DNA, 22 bp, Artificial sequence
  SiRNA target sequence
tctataatcaaattagaaaata

SEQ ID NO: 230938 - DNA, 22 bp, Artificial sequence
  SiRNA target sequence
ctataatcaaattagaaaatat

SEQ ID NO: 230939 - DNA, 22 bp, Artificial sequence
  SiRNA target sequence
tataatcaaattagaaaatatt

SEQ ID NO: 230940 - DNA, 22 bp, Artificial sequence
  SiRNA target sequence
ataatcaaattagaaaatattg

SEQ ID NO: 230941 - DNA, 22 bp, Artificial sequence
  SiRNA target sequence
taatcaaattagaaaatattgt

SEQ ID NO: 230942 - DNA, 22 bp, Artificial sequence
  SiRNA target sequence
aatcaaattagaaaatattgtt

SEQ ID NO: 230943 - DNA, 22 bp, Artificial sequence
  SiRNA target sequence
atcaaattagaaaatattgttg

SEQ ID NO: 230944 - DNA, 22 bp, Artificial sequence
  SiRNA target sequence
tcaaattagaaaatattgttgg

SEQ ID NO: 230945 - DNA, 22 bp, Artificial sequence
  SiRNA target sequence
caaattagaaaatattgttggt

SEQ ID NO: 230946 - DNA, 22 bp, Artificial sequence
  SiRNA target sequence
aaattagaaaatattgttggtg

SEQ ID NO: 230947 - DNA, 22 bp, Artificial sequence
  SiRNA target sequence
aattagaaaatattgttggtgt

SEQ ID NO: 230948 - DNA, 22 bp, Artificial sequence
  SiRNA target sequence
attagaaaatattgttggtgtc

SEQ ID NO: 230949 - DNA, 22 bp, Artificial sequence
  SiRNA target sequence
ttagaaaatattgttggtgtca

SEQ ID NO: 230950 - DNA, 22 bp, Artificial sequence
  SiRNA target sequence
tagaaaatattgttggtgtcat

SEQ ID NO: 230951 - DNA, 22 bp, Artificial sequence
  SiRNA target sequence
agaaaatattgttggtgtcatt

SEQ ID NO: 230952 - DNA, 22 bp, Artificial sequence
  SiRNA target sequence
gaaaatattgttggtgtcattt

SEQ ID NO: 230953 - DNA, 22 bp, Artificial sequence
  SiRNA target sequence
aaaatattgttggtgtcatttg

SEQ ID NO: 230954 - DNA, 22 bp, Artificial sequence
  SiRNA target sequence
aaatattgttggtgtcatttgt

SEQ ID NO: 230955 - DNA, 22 bp, Artificial sequence
  SiRNA target sequence
aatattgttggtgtcatttgtg

SEQ ID NO: 230956 - DNA, 22 bp, Artificial sequence
  SiRNA target sequence
atattgttggtgtcatttgtgt

SEQ ID NO: 230957 - DNA, 22 bp, Artificial sequence
  SiRNA target sequence
tattgttggtgtcatttgtgta

SEQ ID NO: 230958 - DNA, 22 bp, Artificial sequence
  SiRNA target sequence
attgttggtgtcatttgtgtat

SEQ ID NO: 230959 - DNA, 22 bp, Artificial sequence
  SiRNA target sequence
ttgttggtgtcatttgtgtatc

SEQ ID NO: 230960 - DNA, 22 bp, Artificial sequence
  SiRNA target sequence
tgttggtgtcatttgtgtatct

SEQ ID NO: 230961 - DNA, 22 bp, Artificial sequence
  SiRNA target sequence
gttggtgtcatttgtgtatctt

SEQ ID NO: 230962 - DNA, 22 bp, Artificial sequence
  SiRNA target sequence
ttggtgtcatttgtgtatcttt

SEQ ID NO: 230963 - DNA, 22 bp, Artificial sequence
  SiRNA target sequence
tggtgtcatttgtgtatcttta

SEQ ID NO: 230964 - DNA, 22 bp, Artificial sequence
  SiRNA target sequence
ggtgtcatttgtgtatctttaa

SEQ ID NO: 230965 - DNA, 22 bp, Artificial sequence
  SiRNA target sequence
gtgtcatttgtgtatctttaat

SEQ ID NO: 230966 - DNA, 22 bp, Artificial sequence
  SiRNA target sequence
tgtcatttgtgtatctttaatg

SEQ ID NO: 230967 - DNA, 22 bp, Artificial sequence
  SiRNA target sequence
gtcatttgtgtatctttaatga

SEQ ID NO: 230968 - DNA, 22 bp, Artificial sequence
  SiRNA target sequence
tcatttgtgtatctttaatgaa

SEQ ID NO: 230969 - DNA, 22 bp, Artificial sequence
  SiRNA target sequence
catttgtgtatctttaatgaag

SEQ ID NO: 230970 - DNA, 22 bp, Artificial sequence
  SiRNA target sequence
atttgtgtatctttaatgaaga

SEQ ID NO: 230971 - DNA, 22 bp, Artificial sequence
  SiRNA target sequence
tttgtgtatctttaatgaagat

SEQ ID NO: 230972 - DNA, 22 bp, Artificial sequence
  SiRNA target sequence
ttgtgtatctttaatgaagatt

SEQ ID NO: 230973 - DNA, 22 bp, Artificial sequence
  SiRNA target sequence
tgtgtatctttaatgaagattt

SEQ ID NO: 230974 - DNA, 22 bp, Artificial sequence
  SiRNA target sequence
gtgtatctttaatgaagatttc

SEQ ID NO: 230975 - DNA, 22 bp, Artificial sequence
  SiRNA target sequence
tgtatctttaatgaagatttct

SEQ ID NO: 230976 - DNA, 22 bp, Artificial sequence
  SiRNA target sequence
gtatctttaatgaagatttcta

SEQ ID NO: 230977 - DNA, 22 bp, Artificial sequence
  SiRNA target sequence
tatctttaatgaagatttctaa

SEQ ID NO: 230978 - DNA, 22 bp, Artificial sequence
  SiRNA target sequence
atctttaatgaagatttctaaa

SEQ ID NO: 230979 - DNA, 22 bp, Artificial sequence
  SiRNA target sequence
tctttaatgaagatttctaaat

SEQ ID NO: 230980 - DNA, 22 bp, Artificial sequence
  SiRNA target sequence
ctttaatgaagatttctaaata

SEQ ID NO: 230981 - DNA, 22 bp, Artificial sequence
  SiRNA target sequence
tttaatgaagatttctaaatat

SEQ ID NO: 230982 - DNA, 22 bp, Artificial sequence
  SiRNA target sequence
ttaatgaagatttctaaatatg

SEQ ID NO: 230983 - DNA, 22 bp, Artificial sequence
  SiRNA target sequence
taatgaagatttctaaatatgc

SEQ ID NO: 230984 - DNA, 22 bp, Artificial sequence
  SiRNA target sequence
aatgaagatttctaaatatgca

SEQ ID NO: 230985 - DNA, 22 bp, Artificial sequence
  SiRNA target sequence
atgaagatttctaaatatgcag

SEQ ID NO: 230986 - DNA, 22 bp, Artificial sequence
  SiRNA target sequence
tgaagatttctaaatatgcagc

SEQ ID NO: 230987 - DNA, 22 bp, Artificial sequence
  SiRNA target sequence
gaagatttctaaatatgcagca

SEQ ID NO: 230988 - DNA, 22 bp, Artificial sequence
  SiRNA target sequence
aagatttctaaatatgcagcat

SEQ ID NO: 230989 - DNA, 22 bp, Artificial sequence
  SiRNA target sequence
agatttctaaatatgcagcatt

SEQ ID NO: 230990 - DNA, 22 bp, Artificial sequence
  SiRNA target sequence
gatttctaaatatgcagcattt

SEQ ID NO: 230991 - DNA, 22 bp, Artificial sequence
  SiRNA target sequence
atttctaaatatgcagcatttg

SEQ ID NO: 230992 - DNA, 22 bp, Artificial sequence
  SiRNA target sequence
tttctaaatatgcagcatttga

SEQ ID NO: 230993 - DNA, 22 bp, Artificial sequence
  SiRNA target sequence
ttctaaatatgcagcatttgat

SEQ ID NO: 230994 - DNA, 22 bp, Artificial sequence
  SiRNA target sequence
tctaaatatgcagcatttgata

SEQ ID NO: 230995 - DNA, 22 bp, Artificial sequence
  SiRNA target sequence
ctaaatatgcagcatttgatat

SEQ ID NO: 230996 - DNA, 22 bp, Artificial sequence
  SiRNA target sequence
taaatatgcagcatttgatatc

SEQ ID NO: 230997 - DNA, 22 bp, Artificial sequence
  SiRNA target sequence
aaatatgcagcatttgatatca

SEQ ID NO: 230998 - DNA, 22 bp, Artificial sequence
  SiRNA target sequence
aatatgcagcatttgatatcac

SEQ ID NO: 230999 - DNA, 22 bp, Artificial sequence
  SiRNA target sequence
atatgcagcatttgatatcaca

SEQ ID NO: 231000 - DNA, 22 bp, Artificial sequence
  SiRNA target sequence
tatgcagcatttgatatcacaa

SEQ ID NO: 231001 - DNA, 22 bp, Artificial sequence
  SiRNA target sequence
atgcagcatttgatatcacaaa

SEQ ID NO: 231002 - DNA, 22 bp, Artificial sequence
  SiRNA target sequence
tgcagcatttgatatcacaaaa

SEQ ID NO: 231003 - DNA, 22 bp, Artificial sequence
  SiRNA target sequence
gcagcatttgatatcacaaaag

SEQ ID NO: 231004 - DNA, 22 bp, Artificial sequence
  SiRNA target sequence
cagcatttgatatcacaaaaga

SEQ ID NO: 231005 - DNA, 22 bp, Artificial sequence
  SiRNA target sequence
agcatttgatatcacaaaagag

SEQ ID NO: 231006 - DNA, 22 bp, Artificial sequence
  SiRNA target sequence
gcatttgatatcacaaaagagg

SEQ ID NO: 231007 - DNA, 22 bp, Artificial sequence
  SiRNA target sequence
catttgatatcacaaaagaggc

SEQ ID NO: 231008 - DNA, 22 bp, Artificial sequence
  SiRNA target sequence
atttgatatcacaaaagaggct

SEQ ID NO: 231009 - DNA, 22 bp, Artificial sequence
  SiRNA target sequence
tttgatatcacaaaagaggctt

SEQ ID NO: 231010 - DNA, 22 bp, Artificial sequence
  SiRNA target sequence
ttgatatcacaaaagaggcttt

SEQ ID NO: 231011 - DNA, 22 bp, Artificial sequence
  SiRNA target sequence
tgatatcacaaaagaggctttg

SEQ ID NO: 231012 - DNA, 22 bp, Artificial sequence
  SiRNA target sequence
gatatcacaaaagaggctttgt

SEQ ID NO: 231013 - DNA, 22 bp, Artificial sequence
  SiRNA target sequence
atatcacaaaagaggctttgtc

SEQ ID NO: 231014 - DNA, 22 bp, Artificial sequence
  SiRNA target sequence
tatcacaaaagaggctttgtct

SEQ ID NO: 231015 - DNA, 22 bp, Artificial sequence
  SiRNA target sequence
atcacaaaagaggctttgtcta

SEQ ID NO: 231016 - DNA, 22 bp, Artificial sequence
  SiRNA target sequence
tcacaaaagaggctttgtctat

SEQ ID NO: 231017 - DNA, 22 bp, Artificial sequence
  SiRNA target sequence
cacaaaagaggctttgtctatg

SEQ ID NO: 231018 - DNA, 22 bp, Artificial sequence
  SiRNA target sequence
acaaaagaggctttgtctatgc

SEQ ID NO: 231019 - DNA, 22 bp, Artificial sequence
  SiRNA target sequence
caaaagaggctttgtctatgca

SEQ ID NO: 231020 - DNA, 22 bp, Artificial sequence
  SiRNA target sequence
aaaagaggctttgtctatgcag

SEQ ID NO: 231021 - DNA, 22 bp, Artificial sequence
  SiRNA target sequence
aaagaggctttgtctatgcaga

SEQ ID NO: 231022 - DNA, 22 bp, Artificial sequence
  SiRNA target sequence
aagaggctttgtctatgcagat

SEQ ID NO: 231023 - DNA, 22 bp, Artificial sequence
  SiRNA target sequence
agaggctttgtctatgcagatt

SEQ ID NO: 231024 - DNA, 22 bp, Artificial sequence
  SiRNA target sequence
gaggctttgtctatgcagattg

SEQ ID NO: 231025 - DNA, 22 bp, Artificial sequence
  SiRNA target sequence
aggctttgtctatgcagattga

SEQ ID NO: 231026 - DNA, 22 bp, Artificial sequence
  SiRNA target sequence
ggctttgtctatgcagattgat

SEQ ID NO: 231027 - DNA, 22 bp, Artificial sequence
  SiRNA target sequence
gctttgtctatgcagattgatg

SEQ ID NO: 231028 - DNA, 22 bp, Artificial sequence
  SiRNA target sequence
ctttgtctatgcagattgatgg

SEQ ID NO: 231029 - DNA, 22 bp, Artificial sequence
  SiRNA target sequence
tttgtctatgcagattgatggt

SEQ ID NO: 231030 - DNA, 22 bp, Artificial sequence
  SiRNA target sequence
ttgtctatgcagattgatggtt

SEQ ID NO: 231031 - DNA, 22 bp, Artificial sequence
  SiRNA target sequence
tgtctatgcagattgatggttc

SEQ ID NO: 231032 - DNA, 22 bp, Artificial sequence
  SiRNA target sequence
gtctatgcagattgatggttct

SEQ ID NO: 231033 - DNA, 22 bp, Artificial sequence
  SiRNA target sequence
tctatgcagattgatggttcta

SEQ ID NO: 231034 - DNA, 22 bp, Artificial sequence
  SiRNA target sequence
ctatgcagattgatggttctat

SEQ ID NO: 231035 - DNA, 22 bp, Artificial sequence
  SiRNA target sequence
tatgcagattgatggttctata

SEQ ID NO: 231036 - DNA, 22 bp, Artificial sequence
  SiRNA target sequence
atgcagattgatggttctataa

SEQ ID NO: 231037 - DNA, 22 bp, Artificial sequence
  SiRNA target sequence
tgcagattgatggttctataag

SEQ ID NO: 231038 - DNA, 22 bp, Artificial sequence
  SiRNA target sequence
gcagattgatggttctataaga

SEQ ID NO: 231039 - DNA, 22 bp, Artificial sequence
  SiRNA target sequence
cagattgatggttctataagag

SEQ ID NO: 231040 - DNA, 22 bp, Artificial sequence
  SiRNA target sequence
agattgatggttctataagagc

SEQ ID NO: 231041 - DNA, 22 bp, Artificial sequence
  SiRNA target sequence
gattgatggttctataagagcg

SEQ ID NO: 231042 - DNA, 22 bp, Artificial sequence
  SiRNA target sequence
attgatggttctataagagcga

SEQ ID NO: 231043 - DNA, 22 bp, Artificial sequence
  SiRNA target sequence
ttgatggttctataagagcgaa

SEQ ID NO: 231044 - DNA, 22 bp, Artificial sequence
  SiRNA target sequence
tgatggttctataagagcgaaa

SEQ ID NO: 231045 - DNA, 22 bp, Artificial sequence
  SiRNA target sequence
gatggttctataagagcgaaat

SEQ ID NO: 231046 - DNA, 22 bp, Artificial sequence
  SiRNA target sequence
atggttctataagagcgaaata

SEQ ID NO: 231047 - DNA, 22 bp, Artificial sequence
  SiRNA target sequence
tggttctataagagcgaaatac

SEQ ID NO: 231048 - DNA, 22 bp, Artificial sequence
  SiRNA target sequence
ggttctataagagcgaaataca

SEQ ID NO: 231049 - DNA, 22 bp, Artificial sequence
  SiRNA target sequence
gttctataagagcgaaatacaa

SEQ ID NO: 231050 - DNA, 22 bp, Artificial sequence
  SiRNA target sequence
ttctataagagcgaaatacaaa

SEQ ID NO: 231051 - DNA, 22 bp, Artificial sequence
  SiRNA target sequence
tctataagagcgaaatacaaag

SEQ ID NO: 231052 - DNA, 22 bp, Artificial sequence
  SiRNA target sequence
ctataagagcgaaatacaaagg

SEQ ID NO: 231053 - DNA, 22 bp, Artificial sequence
  SiRNA target sequence
tataagagcgaaatacaaaggt

SEQ ID NO: 231054 - DNA, 22 bp, Artificial sequence
  SiRNA target sequence
ataagagcgaaatacaaaggta

SEQ ID NO: 231055 - DNA, 22 bp, Artificial sequence
  SiRNA target sequence
taagagcgaaatacaaaggtat

SEQ ID NO: 231056 - DNA, 22 bp, Artificial sequence
  SiRNA target sequence
aagagcgaaatacaaaggtatt

SEQ ID NO: 231057 - DNA, 22 bp, Artificial sequence
  SiRNA target sequence
agagcgaaatacaaaggtattt

SEQ ID NO: 231058 - DNA, 22 bp, Artificial sequence
  SiRNA target sequence
gagcgaaatacaaaggtatttt

SEQ ID NO: 231059 - DNA, 22 bp, Artificial sequence
  SiRNA target sequence
agcgaaatacaaaggtattttt

SEQ ID NO: 231060 - DNA, 22 bp, Artificial sequence
  SiRNA target sequence
gcgaaatacaaaggtatttttg

SEQ ID NO: 231061 - DNA, 22 bp, Artificial sequence
  SiRNA target sequence
cgaaatacaaaggtatttttga

SEQ ID NO: 231062 - DNA, 22 bp, Artificial sequence
  SiRNA target sequence
gaaatacaaaggtatttttgat

SEQ ID NO: 231063 - DNA, 22 bp, Artificial sequence
  SiRNA target sequence
aaatacaaaggtatttttgatg

SEQ ID NO: 231064 - DNA, 22 bp, Artificial sequence
  SiRNA target sequence
aatacaaaggtatttttgatgg

SEQ ID NO: 231065 - DNA, 22 bp, Artificial sequence
  SiRNA target sequence
atacaaaggtatttttgatggt

SEQ ID NO: 231066 - DNA, 22 bp, Artificial sequence
  SiRNA target sequence
tacaaaggtatttttgatggtg

SEQ ID NO: 231067 - DNA, 22 bp, Artificial sequence
  SiRNA target sequence
acaaaggtatttttgatggtgt

SEQ ID NO: 231068 - DNA, 22 bp, Artificial sequence
  SiRNA target sequence
caaaggtatttttgatggtgta

SEQ ID NO: 231069 - DNA, 22 bp, Artificial sequence
  SiRNA target sequence
aaaggtatttttgatggtgtat

SEQ ID NO: 231070 - DNA, 22 bp, Artificial sequence
  SiRNA target sequence
aaggtatttttgatggtgtatt

SEQ ID NO: 231071 - DNA, 22 bp, Artificial sequence
  SiRNA target sequence
aggtatttttgatggtgtattt

SEQ ID NO: 231072 - DNA, 22 bp, Artificial sequence
  SiRNA target sequence
ggtatttttgatggtgtatttg

SEQ ID NO: 231073 - DNA, 22 bp, Artificial sequence
  SiRNA target sequence
gtatttttgatggtgtatttgg

SEQ ID NO: 231074 - DNA, 22 bp, Artificial sequence
  SiRNA target sequence
tatttttgatggtgtatttggt

SEQ ID NO: 231075 - DNA, 22 bp, Artificial sequence
  SiRNA target sequence
atttttgatggtgtatttggta

SEQ ID NO: 231076 - DNA, 22 bp, Artificial sequence
  SiRNA target sequence
tttttgatggtgtatttggtaa

SEQ ID NO: 231077 - DNA, 22 bp, Artificial sequence
  SiRNA target sequence
ttttgatggtgtatttggtaag

SEQ ID NO: 231078 - DNA, 22 bp, Artificial sequence
  SiRNA target sequence
tttgatggtgtatttggtaagc

SEQ ID NO: 231079 - DNA, 22 bp, Artificial sequence
  SiRNA target sequence
ttgatggtgtatttggtaagct

SEQ ID NO: 231080 - DNA, 22 bp, Artificial sequence
  SiRNA target sequence
tgatggtgtatttggtaagctg

SEQ ID NO: 231081 - DNA, 22 bp, Artificial sequence
  SiRNA target sequence
gatggtgtatttggtaagctgg

SEQ ID NO: 231082 - DNA, 22 bp, Artificial sequence
  SiRNA target sequence
atggtgtatttggtaagctggg

SEQ ID NO: 231083 - DNA, 22 bp, Artificial sequence
  SiRNA target sequence
tggtgtatttggtaagctgggg

SEQ ID NO: 231084 - DNA, 22 bp, Artificial sequence
  SiRNA target sequence
ggtgtatttggtaagctgggga

SEQ ID NO: 231085 - DNA, 22 bp, Artificial sequence
  SiRNA target sequence
gtgtatttggtaagctggggaa

SEQ ID NO: 231086 - DNA, 22 bp, Artificial sequence
  SiRNA target sequence
tgtatttggtaagctggggaaa

SEQ ID NO: 231087 - DNA, 22 bp, Artificial sequence
  SiRNA target sequence
gtatttggtaagctggggaaat

SEQ ID NO: 231088 - DNA, 22 bp, Artificial sequence
  SiRNA target sequence
tatttggtaagctggggaaatc

SEQ ID NO: 231089 - DNA, 22 bp, Artificial sequence
  SiRNA target sequence
atttggtaagctggggaaatct

SEQ ID NO: 231090 - DNA, 22 bp, Artificial sequence
  SiRNA target sequence
tttggtaagctggggaaatctt

SEQ ID NO: 231091 - DNA, 22 bp, Artificial sequence
  SiRNA target sequence
ttggtaagctggggaaatcttt

SEQ ID NO: 231092 - DNA, 22 bp, Artificial sequence
  SiRNA target sequence
tggtaagctggggaaatctttt

SEQ ID NO: 231093 - DNA, 22 bp, Artificial sequence
  SiRNA target sequence
ggtaagctggggaaatcttttg

SEQ ID NO: 231094 - DNA, 22 bp, Artificial sequence
  SiRNA target sequence
gtaagctggggaaatcttttgg

SEQ ID NO: 231095 - DNA, 22 bp, Artificial sequence
  SiRNA target sequence
taagctggggaaatcttttgga

SEQ ID NO: 231096 - DNA, 22 bp, Artificial sequence
  SiRNA target sequence
aagctggggaaatcttttggat

SEQ ID NO: 231097 - DNA, 22 bp, Artificial sequence
  SiRNA target sequence
agctggggaaatcttttggatc

SEQ ID NO: 231098 - DNA, 22 bp, Artificial sequence
  SiRNA target sequence
gctggggaaatcttttggatca

SEQ ID NO: 231099 - DNA, 22 bp, Artificial sequence
  SiRNA target sequence
ctggggaaatcttttggatcag

SEQ ID NO: 231100 - DNA, 22 bp, Artificial sequence
  SiRNA target sequence
tggggaaatcttttggatcagt

SEQ ID NO: 231101 - DNA, 22 bp, Artificial sequence
  SiRNA target sequence
ggggaaatcttttggatcagtt

SEQ ID NO: 231102 - DNA, 22 bp, Artificial sequence
  SiRNA target sequence
gggaaatcttttggatcagttt

SEQ ID NO: 231103 - DNA, 22 bp, Artificial sequence
  SiRNA target sequence
ggaaatcttttggatcagttta

SEQ ID NO: 231104 - DNA, 22 bp, Artificial sequence
  SiRNA target sequence
gaaatcttttggatcagtttat

SEQ ID NO: 231105 - DNA, 22 bp, Artificial sequence
  SiRNA target sequence
aaatcttttggatcagtttatg

SEQ ID NO: 231106 - DNA, 22 bp, Artificial sequence
  SiRNA target sequence
aatcttttggatcagtttatgg

SEQ ID NO: 231107 - DNA, 22 bp, Artificial sequence
  SiRNA target sequence
atcttttggatcagtttatgga

SEQ ID NO: 231108 - DNA, 22 bp, Artificial sequence
  SiRNA target sequence
tcttttggatcagtttatggat

SEQ ID NO: 231109 - DNA, 22 bp, Artificial sequence
  SiRNA target sequence
cttttggatcagtttatggatt

SEQ ID NO: 231110 - DNA, 22 bp, Artificial sequence
  SiRNA target sequence
ttttggatcagtttatggattt

SEQ ID NO: 231111 - DNA, 22 bp, Artificial sequence
  SiRNA target sequence
tttggatcagtttatggattta

SEQ ID NO: 231112 - DNA, 22 bp, Artificial sequence
  SiRNA target sequence
ttggatcagtttatggatttac

SEQ ID NO: 231113 - DNA, 22 bp, Artificial sequence
  SiRNA target sequence
tggatcagtttatggatttaca

SEQ ID NO: 231114 - DNA, 22 bp, Artificial sequence
  SiRNA target sequence
ggatcagtttatggatttacaa

SEQ ID NO: 231115 - DNA, 22 bp, Artificial sequence
  SiRNA target sequence
gatcagtttatggatttacaat

SEQ ID NO: 231116 - DNA, 22 bp, Artificial sequence
  SiRNA target sequence
atcagtttatggatttacaatt

SEQ ID NO: 231117 - DNA, 22 bp, Artificial sequence
  SiRNA target sequence
tcagtttatggatttacaatta

SEQ ID NO: 231118 - DNA, 22 bp, Artificial sequence
  SiRNA target sequence
cagtttatggatttacaattac

SEQ ID NO: 231119 - DNA, 22 bp, Artificial sequence
  SiRNA target sequence
agtttatggatttacaattact

SEQ ID NO: 231120 - DNA, 22 bp, Artificial sequence
  SiRNA target sequence
gtttatggatttacaattacta

SEQ ID NO: 231121 - DNA, 22 bp, Artificial sequence
  SiRNA target sequence
tttatggatttacaattactac

SEQ ID NO: 231122 - DNA, 22 bp, Artificial sequence
  SiRNA target sequence
ttatggatttacaattactaca

SEQ ID NO: 231123 - DNA, 22 bp, Artificial sequence
  SiRNA target sequence
tatggatttacaattactacat

SEQ ID NO: 231124 - DNA, 22 bp, Artificial sequence
  SiRNA target sequence
atggatttacaattactacatt

SEQ ID NO: 231125 - DNA, 22 bp, Artificial sequence
  SiRNA target sequence
tggatttacaattactacatta

SEQ ID NO: 231126 - DNA, 22 bp, Artificial sequence
  SiRNA target sequence
ggatttacaattactacattat

SEQ ID NO: 231127 - DNA, 22 bp, Artificial sequence
  SiRNA target sequence
gatttacaattactacattatt

SEQ ID NO: 231128 - DNA, 22 bp, Artificial sequence
  SiRNA target sequence
atttacaattactacattatta

SEQ ID NO: 231129 - DNA, 22 bp, Artificial sequence
  SiRNA target sequence
tttacaattactacattattag

SEQ ID NO: 231130 - DNA, 22 bp, Artificial sequence
  SiRNA target sequence
ttacaattactacattattagg

SEQ ID NO: 231131 - DNA, 22 bp, Artificial sequence
  SiRNA target sequence
tacaattactacattattagga

SEQ ID NO: 231132 - DNA, 22 bp, Artificial sequence
  SiRNA target sequence
acaattactacattattaggaa

SEQ ID NO: 231133 - DNA, 22 bp, Artificial sequence
  SiRNA target sequence
caattactacattattaggaac

SEQ ID NO: 231134 - DNA, 22 bp, Artificial sequence
  SiRNA target sequence
aattactacattattaggaaca

SEQ ID NO: 231135 - DNA, 22 bp, Artificial sequence
  SiRNA target sequence
attactacattattaggaacaa

SEQ ID NO: 231136 - DNA, 22 bp, Artificial sequence
  SiRNA target sequence
ttactacattattaggaacaag

SEQ ID NO: 231137 - DNA, 22 bp, Artificial sequence
  SiRNA target sequence
tactacattattaggaacaaga

SEQ ID NO: 231138 - DNA, 22 bp, Artificial sequence
  SiRNA target sequence
actacattattaggaacaagag

SEQ ID NO: 231139 - DNA, 22 bp, Artificial sequence
  SiRNA target sequence
ctacattattaggaacaagaga

SEQ ID NO: 231140 - DNA, 22 bp, Artificial sequence
  SiRNA target sequence
tacattattaggaacaagagat

SEQ ID NO: 231141 - DNA, 22 bp, Artificial sequence
  SiRNA target sequence
acattattaggaacaagagatg

SEQ ID NO: 231142 - DNA, 22 bp, Artificial sequence
  SiRNA target sequence
cattattaggaacaagagatgt

SEQ ID NO: 231143 - DNA, 22 bp, Artificial sequence
  SiRNA target sequence
attattaggaacaagagatgtt

SEQ ID NO: 231144 - DNA, 22 bp, Artificial sequence
  SiRNA target sequence
ttattaggaacaagagatgttc

SEQ ID NO: 231145 - DNA, 22 bp, Artificial sequence
  SiRNA target sequence
tattaggaacaagagatgttcg

SEQ ID NO: 231146 - DNA, 22 bp, Artificial sequence
  SiRNA target sequence
attaggaacaagagatgttcgt

SEQ ID NO: 231147 - DNA, 22 bp, Artificial sequence
  SiRNA target sequence
ttaggaacaagagatgttcgta

SEQ ID NO: 231148 - DNA, 22 bp, Artificial sequence
  SiRNA target sequence
taggaacaagagatgttcgtag

SEQ ID NO: 231149 - DNA, 22 bp, Artificial sequence
  SiRNA target sequence
aggaacaagagatgttcgtaga

SEQ ID NO: 231150 - DNA, 22 bp, Artificial sequence
  SiRNA target sequence
ggaacaagagatgttcgtagag

SEQ ID NO: 231151 - DNA, 22 bp, Artificial sequence
  SiRNA target sequence
gaacaagagatgttcgtagagg

SEQ ID NO: 231152 - DNA, 22 bp, Artificial sequence
  SiRNA target sequence
aacaagagatgttcgtagaggt

SEQ ID NO: 231153 - DNA, 22 bp, Artificial sequence
  SiRNA target sequence
acaagagatgttcgtagaggtg

SEQ ID NO: 231154 - DNA, 22 bp, Artificial sequence
  SiRNA target sequence
caagagatgttcgtagaggtgc

SEQ ID NO: 231155 - DNA, 22 bp, Artificial sequence
  SiRNA target sequence
aagagatgttcgtagaggtgct

SEQ ID NO: 231156 - DNA, 22 bp, Artificial sequence
  SiRNA target sequence
agagatgttcgtagaggtgctc

SEQ ID NO: 231157 - DNA, 22 bp, Artificial sequence
  SiRNA target sequence
gagatgttcgtagaggtgctcc

SEQ ID NO: 231158 - DNA, 22 bp, Artificial sequence
  SiRNA target sequence
agatgttcgtagaggtgctcct

SEQ ID NO: 231159 - DNA, 22 bp, Artificial sequence
  SiRNA target sequence
gatgttcgtagaggtgctccta

SEQ ID NO: 231160 - DNA, 22 bp, Artificial sequence
  SiRNA target sequence
atgttcgtagaggtgctcctat

SEQ ID NO: 231161 - DNA, 22 bp, Artificial sequence
  SiRNA target sequence
tgttcgtagaggtgctcctata

SEQ ID NO: 231162 - DNA, 22 bp, Artificial sequence
  SiRNA target sequence
gttcgtagaggtgctcctatat

SEQ ID NO: 231163 - DNA, 22 bp, Artificial sequence
  SiRNA target sequence
ttcgtagaggtgctcctatatc

SEQ ID NO: 231164 - DNA, 22 bp, Artificial sequence
  SiRNA target sequence
tcgtagaggtgctcctatatcg

SEQ ID NO: 231165 - DNA, 22 bp, Artificial sequence
  SiRNA target sequence
cgtagaggtgctcctatatcgc

SEQ ID NO: 231166 - DNA, 22 bp, Artificial sequence
  SiRNA target sequence
gtagaggtgctcctatatcgct

SEQ ID NO: 231167 - DNA, 22 bp, Artificial sequence
  SiRNA target sequence
tagaggtgctcctatatcgctt

SEQ ID NO: 231168 - DNA, 22 bp, Artificial sequence
  SiRNA target sequence
agaggtgctcctatatcgcttt

SEQ ID NO: 231169 - DNA, 22 bp, Artificial sequence
  SiRNA target sequence
gaggtgctcctatatcgctttg

SEQ ID NO: 231170 - DNA, 22 bp, Artificial sequence
  SiRNA target sequence
aggtgctcctatatcgctttgt

SEQ ID NO: 231171 - DNA, 22 bp, Artificial sequence
  SiRNA target sequence
ggtgctcctatatcgctttgtg

SEQ ID NO: 231172 - DNA, 22 bp, Artificial sequence
  SiRNA target sequence
gtgctcctatatcgctttgtgt

SEQ ID NO: 231173 - DNA, 22 bp, Artificial sequence
  SiRNA target sequence
tgctcctatatcgctttgtgtt

SEQ ID NO: 231174 - DNA, 22 bp, Artificial sequence
  SiRNA target sequence
gctcctatatcgctttgtgttc

SEQ ID NO: 231175 - DNA, 22 bp, Artificial sequence
  SiRNA target sequence
ctcctatatcgctttgtgttct

SEQ ID NO: 231176 - DNA, 22 bp, Artificial sequence
  SiRNA target sequence
tcctatatcgctttgtgttcta

SEQ ID NO: 231177 - DNA, 22 bp, Artificial sequence
  SiRNA target sequence
cctatatcgctttgtgttctaa

SEQ ID NO: 231178 - DNA, 22 bp, Artificial sequence
  SiRNA target sequence
ctatatcgctttgtgttctaat

SEQ ID NO: 231179 - DNA, 22 bp, Artificial sequence
  SiRNA target sequence
tatatcgctttgtgttctaata

SEQ ID NO: 231180 - DNA, 22 bp, Artificial sequence
  SiRNA target sequence
atatcgctttgtgttctaatat

SEQ ID NO: 231181 - DNA, 22 bp, Artificial sequence
  SiRNA target sequence
tatcgctttgtgttctaatatt

SEQ ID NO: 231182 - DNA, 22 bp, Artificial sequence
  SiRNA target sequence
atcgctttgtgttctaatattg

SEQ ID NO: 231183 - DNA, 22 bp, Artificial sequence
  SiRNA target sequence
tcgctttgtgttctaatattgt

SEQ ID NO: 231184 - DNA, 22 bp, Artificial sequence
  SiRNA target sequence
cgctttgtgttctaatattgtt

SEQ ID NO: 231185 - DNA, 22 bp, Artificial sequence
  SiRNA target sequence
gctttgtgttctaatattgttc

SEQ ID NO: 231186 - DNA, 22 bp, Artificial sequence
  SiRNA target sequence
ctttgtgttctaatattgttct

SEQ ID NO: 231187 - DNA, 22 bp, Artificial sequence
  SiRNA target sequence
tttgtgttctaatattgttctg

SEQ ID NO: 231188 - DNA, 22 bp, Artificial sequence
  SiRNA target sequence
ttgtgttctaatattgttctgc

SEQ ID NO: 231189 - DNA, 22 bp, Artificial sequence
  SiRNA target sequence
tgtgttctaatattgttctgcc

SEQ ID NO: 231190 - DNA, 22 bp, Artificial sequence
  SiRNA target sequence
gtgttctaatattgttctgcct

SEQ ID NO: 231191 - DNA, 22 bp, Artificial sequence
  SiRNA target sequence
tgttctaatattgttctgcctt

SEQ ID NO: 231192 - DNA, 22 bp, Artificial sequence
  SiRNA target sequence
gttctaatattgttctgcctta

SEQ ID NO: 231193 - DNA, 22 bp, Artificial sequence
  SiRNA target sequence
ttctaatattgttctgccttat

SEQ ID NO: 231194 - DNA, 22 bp, Artificial sequence
  SiRNA target sequence
tctaatattgttctgccttata

SEQ ID NO: 231195 - DNA, 22 bp, Artificial sequence
  SiRNA target sequence
ctaatattgttctgccttatat

SEQ ID NO: 231196 - DNA, 22 bp, Artificial sequence
  SiRNA target sequence
taatattgttctgccttatatg

SEQ ID NO: 231197 - DNA, 22 bp, Artificial sequence
  SiRNA target sequence
aatattgttctgccttatatgg

SEQ ID NO: 231198 - DNA, 22 bp, Artificial sequence
  SiRNA target sequence
atattgttctgccttatatggt

SEQ ID NO: 231199 - DNA, 22 bp, Artificial sequence
  SiRNA target sequence
tattgttctgccttatatggtt

SEQ ID NO: 231200 - DNA, 22 bp, Artificial sequence
  SiRNA target sequence
attgttctgccttatatggttt

SEQ ID NO: 231201 - DNA, 22 bp, Artificial sequence
  SiRNA target sequence
ttgttctgccttatatggtttt

SEQ ID NO: 231202 - DNA, 22 bp, Artificial sequence
  SiRNA target sequence
tgttctgccttatatggtttta

SEQ ID NO: 231203 - DNA, 22 bp, Artificial sequence
  SiRNA target sequence
gttctgccttatatggttttat

SEQ ID NO: 231204 - DNA, 22 bp, Artificial sequence
  SiRNA target sequence
ttctgccttatatggttttatt

SEQ ID NO: 231205 - DNA, 22 bp, Artificial sequence
  SiRNA target sequence
tctgccttatatggttttattc

SEQ ID NO: 231206 - DNA, 22 bp, Artificial sequence
  SiRNA target sequence
ctgccttatatggttttattct

SEQ ID NO: 231207 - DNA, 22 bp, Artificial sequence
  SiRNA target sequence
tgccttatatggttttattctg

SEQ ID NO: 231208 - DNA, 22 bp, Artificial sequence
  SiRNA target sequence
gccttatatggttttattctgt

SEQ ID NO: 231209 - DNA, 22 bp, Artificial sequence
  SiRNA target sequence
ccttatatggttttattctgtt

SEQ ID NO: 231210 - DNA, 22 bp, Artificial sequence
  SiRNA target sequence
cttatatggttttattctgttt

SEQ ID NO: 231211 - DNA, 22 bp, Artificial sequence
  SiRNA target sequence
ttatatggttttattctgtttt

SEQ ID NO: 231212 - DNA, 22 bp, Artificial sequence
  SiRNA target sequence
tatatggttttattctgttttc

SEQ ID NO: 231213 - DNA, 22 bp, Artificial sequence
  SiRNA target sequence
atatggttttattctgttttct

SEQ ID NO: 231214 - DNA, 22 bp, Artificial sequence
  SiRNA target sequence
tatggttttattctgttttcta

SEQ ID NO: 231215 - DNA, 22 bp, Artificial sequence
  SiRNA target sequence
atggttttattctgttttctat

SEQ ID NO: 231216 - DNA, 22 bp, Artificial sequence
  SiRNA target sequence
tggttttattctgttttctatc

SEQ ID NO: 231217 - DNA, 22 bp, Artificial sequence
  SiRNA target sequence
ggttttattctgttttctatct

SEQ ID NO: 231218 - DNA, 22 bp, Artificial sequence
  SiRNA target sequence
gttttattctgttttctatctc

SEQ ID NO: 231219 - DNA, 22 bp, Artificial sequence
  SiRNA target sequence
ttttattctgttttctatctca

SEQ ID NO: 231220 - DNA, 22 bp, Artificial sequence
  SiRNA target sequence
tttattctgttttctatctcaa

SEQ ID NO: 231221 - DNA, 22 bp, Artificial sequence
  SiRNA target sequence
ttattctgttttctatctcaat

SEQ ID NO: 231222 - DNA, 22 bp, Artificial sequence
  SiRNA target sequence
tattctgttttctatctcaata

SEQ ID NO: 231223 - DNA, 22 bp, Artificial sequence
  SiRNA target sequence
attctgttttctatctcaatag

SEQ ID NO: 231224 - DNA, 22 bp, Artificial sequence
  SiRNA target sequence
ttctgttttctatctcaataga

SEQ ID NO: 231225 - DNA, 22 bp, Artificial sequence
  SiRNA target sequence
tctgttttctatctcaatagaa

SEQ ID NO: 231226 - DNA, 22 bp, Artificial sequence
  SiRNA target sequence
ctgttttctatctcaatagaaa

SEQ ID NO: 231227 - DNA, 22 bp, Artificial sequence
  SiRNA target sequence
tgttttctatctcaatagaaaa

SEQ ID NO: 231228 - DNA, 22 bp, Artificial sequence
  SiRNA target sequence
gttttctatctcaatagaaaat

SEQ ID NO: 231229 - DNA, 22 bp, Artificial sequence
  SiRNA target sequence
ttttctatctcaatagaaaata

SEQ ID NO: 231230 - DNA, 22 bp, Artificial sequence
  SiRNA target sequence
tttctatctcaatagaaaatat

SEQ ID NO: 231231 - DNA, 22 bp, Artificial sequence
  SiRNA target sequence
ttctatctcaatagaaaatata

SEQ ID NO: 231232 - DNA, 22 bp, Artificial sequence
  SiRNA target sequence
tctatctcaatagaaaatataa

SEQ ID NO: 231233 - DNA, 22 bp, Artificial sequence
  SiRNA target sequence
ctatctcaatagaaaatataaa

SEQ ID NO: 231234 - DNA, 22 bp, Artificial sequence
  SiRNA target sequence
tatctcaatagaaaatataaag

SEQ ID NO: 231235 - DNA, 22 bp, Artificial sequence
  SiRNA target sequence
atctcaatagaaaatataaaga

SEQ ID NO: 231236 - DNA, 22 bp, Artificial sequence
  SiRNA target sequence
tctcaatagaaaatataaagaa

SEQ ID NO: 231237 - DNA, 22 bp, Artificial sequence
  SiRNA target sequence
ctcaatagaaaatataaagaat

SEQ ID NO: 231238 - DNA, 22 bp, Artificial sequence
  SiRNA target sequence
tcaatagaaaatataaagaatc

SEQ ID NO: 231239 - DNA, 22 bp, Artificial sequence
  SiRNA target sequence
caatagaaaatataaagaatct

SEQ ID NO: 231240 - DNA, 22 bp, Artificial sequence
  SiRNA target sequence
aatagaaaatataaagaatctg

SEQ ID NO: 231241 - DNA, 22 bp, Artificial sequence
  SiRNA target sequence
atagaaaatataaagaatctgt

SEQ ID NO: 231242 - DNA, 22 bp, Artificial sequence
  SiRNA target sequence
tagaaaatataaagaatctgtc

SEQ ID NO: 231243 - DNA, 22 bp, Artificial sequence
  SiRNA target sequence
agaaaatataaagaatctgtcg

SEQ ID NO: 231244 - DNA, 22 bp, Artificial sequence
  SiRNA target sequence
gaaaatataaagaatctgtcga

SEQ ID NO: 231245 - DNA, 22 bp, Artificial sequence
  SiRNA target sequence
aaaatataaagaatctgtcgag

SEQ ID NO: 231246 - DNA, 22 bp, Artificial sequence
  SiRNA target sequence
aaatataaagaatctgtcgaga

SEQ ID NO: 231247 - DNA, 22 bp, Artificial sequence
  SiRNA target sequence
aatataaagaatctgtcgagaa

SEQ ID NO: 231248 - DNA, 22 bp, Artificial sequence
  SiRNA target sequence
atataaagaatctgtcgagaat

SEQ ID NO: 231249 - DNA, 22 bp, Artificial sequence
  SiRNA target sequence
tataaagaatctgtcgagaata

SEQ ID NO: 231250 - DNA, 22 bp, Artificial sequence
  SiRNA target sequence
ataaagaatctgtcgagaataa

SEQ ID NO: 231251 - DNA, 22 bp, Artificial sequence
  SiRNA target sequence
taaagaatctgtcgagaataat

SEQ ID NO: 231252 - DNA, 22 bp, Artificial sequence
  SiRNA target sequence
aaagaatctgtcgagaataatg

SEQ ID NO: 231253 - DNA, 22 bp, Artificial sequence
  SiRNA target sequence
aagaatctgtcgagaataatgc

SEQ ID NO: 231254 - DNA, 22 bp, Artificial sequence
  SiRNA target sequence
agaatctgtcgagaataatgca

SEQ ID NO: 231255 - DNA, 22 bp, Artificial sequence
  SiRNA target sequence
gaatctgtcgagaataatgcac

SEQ ID NO: 231256 - DNA, 22 bp, Artificial sequence
  SiRNA target sequence
aatctgtcgagaataatgcacc

SEQ ID NO: 231257 - DNA, 22 bp, Artificial sequence
  SiRNA target sequence
atctgtcgagaataatgcacca

SEQ ID NO: 231258 - DNA, 22 bp, Artificial sequence
  SiRNA target sequence
tctgtcgagaataatgcaccaa

SEQ ID NO: 231259 - DNA, 22 bp, Artificial sequence
  SiRNA target sequence
ctgtcgagaataatgcaccaat

SEQ ID NO: 231260 - DNA, 22 bp, Artificial sequence
  SiRNA target sequence
tgtcgagaataatgcaccaatt

SEQ ID NO: 231261 - DNA, 22 bp, Artificial sequence
  SiRNA target sequence
gtcgagaataatgcaccaattg

SEQ ID NO: 231262 - DNA, 22 bp, Artificial sequence
  SiRNA target sequence
tcgagaataatgcaccaattga

SEQ ID NO: 231263 - DNA, 22 bp, Artificial sequence
  SiRNA target sequence
cgagaataatgcaccaattgat

SEQ ID NO: 231264 - DNA, 22 bp, Artificial sequence
  SiRNA target sequence
gagaataatgcaccaattgata

SEQ ID NO: 231265 - DNA, 22 bp, Artificial sequence
  SiRNA target sequence
agaataatgcaccaattgatat

SEQ ID NO: 231266 - DNA, 22 bp, Artificial sequence
  SiRNA target sequence
gaataatgcaccaattgatatt

SEQ ID NO: 231267 - DNA, 22 bp, Artificial sequence
  SiRNA target sequence
aataatgcaccaattgatattg

SEQ ID NO: 231268 - DNA, 22 bp, Artificial sequence
  SiRNA target sequence
ataatgcaccaattgatattga

SEQ ID NO: 231269 - DNA, 22 bp, Artificial sequence
  SiRNA target sequence
taatgcaccaattgatattgat

SEQ ID NO: 231270 - DNA, 22 bp, Artificial sequence
  SiRNA target sequence
aatgcaccaattgatattgatt

SEQ ID NO: 231271 - DNA, 22 bp, Artificial sequence
  SiRNA target sequence
atgcaccaattgatattgattt

SEQ ID NO: 231272 - DNA, 22 bp, Artificial sequence
  SiRNA target sequence
tgcaccaattgatattgattta

SEQ ID NO: 231273 - DNA, 22 bp, Artificial sequence
  SiRNA target sequence
gcaccaattgatattgatttat

SEQ ID NO: 231274 - DNA, 22 bp, Artificial sequence
  SiRNA target sequence
caccaattgatattgatttatt

SEQ ID NO: 231275 - DNA, 22 bp, Artificial sequence
  SiRNA target sequence
accaattgatattgatttattc

SEQ ID NO: 231276 - DNA, 22 bp, Artificial sequence
  SiRNA target sequence
ccaattgatattgatttattca

SEQ ID NO: 231277 - DNA, 22 bp, Artificial sequence
  SiRNA target sequence
caattgatattgatttattcac

SEQ ID NO: 231278 - DNA, 22 bp, Artificial sequence
  SiRNA target sequence
aattgatattgatttattcact

SEQ ID NO: 231279 - DNA, 22 bp, Artificial sequence
  SiRNA target sequence
attgatattgatttattcacta

SEQ ID NO: 231280 - DNA, 22 bp, Artificial sequence
  SiRNA target sequence
ttgatattgatttattcactag

SEQ ID NO: 231281 - DNA, 22 bp, Artificial sequence
  SiRNA target sequence
tgatattgatttattcactagt

SEQ ID NO: 231282 - DNA, 22 bp, Artificial sequence
  SiRNA target sequence
gatattgatttattcactagtt

SEQ ID NO: 231283 - DNA, 22 bp, Artificial sequence
  SiRNA target sequence
atattgatttattcactagttc

SEQ ID NO: 231284 - DNA, 22 bp, Artificial sequence
  SiRNA target sequence
tattgatttattcactagttca

SEQ ID NO: 231285 - DNA, 22 bp, Artificial sequence
  SiRNA target sequence
attgatttattcactagttcaa

SEQ ID NO: 231286 - DNA, 22 bp, Artificial sequence
  SiRNA target sequence
ttgatttattcactagttcaaa

SEQ ID NO: 231287 - DNA, 22 bp, Artificial sequence
  SiRNA target sequence
tgatttattcactagttcaaaa

SEQ ID NO: 231288 - DNA, 22 bp, Artificial sequence
  SiRNA target sequence
gatttattcactagttcaaaag

SEQ ID NO: 231289 - DNA, 22 bp, Artificial sequence
  SiRNA target sequence
atttattcactagttcaaaagt

SEQ ID NO: 231290 - DNA, 22 bp, Artificial sequence
  SiRNA target sequence
tttattcactagttcaaaagtc

SEQ ID NO: 231291 - DNA, 22 bp, Artificial sequence
  SiRNA target sequence
ttattcactagttcaaaagtca

SEQ ID NO: 231292 - DNA, 22 bp, Artificial sequence
  SiRNA target sequence
tattcactagttcaaaagtcaa

SEQ ID NO: 231293 - DNA, 22 bp, Artificial sequence
  SiRNA target sequence
attcactagttcaaaagtcaag

SEQ ID NO: 231294 - DNA, 22 bp, Artificial sequence
  SiRNA target sequence
ttcactagttcaaaagtcaagg

SEQ ID NO: 231295 - DNA, 22 bp, Artificial sequence
  SiRNA target sequence
tcactagttcaaaagtcaaggc

SEQ ID NO: 231296 - DNA, 22 bp, Artificial sequence
  SiRNA target sequence
cactagttcaaaagtcaaggca

SEQ ID NO: 231297 - DNA, 22 bp, Artificial sequence
  SiRNA target sequence
actagttcaaaagtcaaggcac

SEQ ID NO: 231298 - DNA, 22 bp, Artificial sequence
  SiRNA target sequence
ctagttcaaaagtcaaggcacc

SEQ ID NO: 231299 - DNA, 22 bp, Artificial sequence
  SiRNA target sequence
tagttcaaaagtcaaggcacct

SEQ ID NO: 231300 - DNA, 22 bp, Artificial sequence
  SiRNA target sequence
agttcaaaagtcaaggcacctt

SEQ ID NO: 231301 - DNA, 22 bp, Artificial sequence
  SiRNA target sequence
gttcaaaagtcaaggcaccttc

SEQ ID NO: 231302 - DNA, 22 bp, Artificial sequence
  SiRNA target sequence
ttcaaaagtcaaggcaccttct

SEQ ID NO: 231303 - DNA, 22 bp, Artificial sequence
  SiRNA target sequence
tcaaaagtcaaggcaccttctt

SEQ ID NO: 231304 - DNA, 22 bp, Artificial sequence
  SiRNA target sequence
caaaagtcaaggcaccttcttc

SEQ ID NO: 231305 - DNA, 22 bp, Artificial sequence
  SiRNA target sequence
aaaagtcaaggcaccttcttct

SEQ ID NO: 231306 - DNA, 22 bp, Artificial sequence
  SiRNA target sequence
aaagtcaaggcaccttcttctg

SEQ ID NO: 231307 - DNA, 22 bp, Artificial sequence
  SiRNA target sequence
aagtcaaggcaccttcttctga

SEQ ID NO: 231308 - DNA, 22 bp, Artificial sequence
  SiRNA target sequence
agtcaaggcaccttcttctgaa

SEQ ID NO: 231309 - DNA, 22 bp, Artificial sequence
  SiRNA target sequence
gtcaaggcaccttcttctgaac

SEQ ID NO: 231310 - DNA, 22 bp, Artificial sequence
  SiRNA target sequence
tcaaggcaccttcttctgaacc

SEQ ID NO: 231311 - DNA, 22 bp, Artificial sequence
  SiRNA target sequence
caaggcaccttcttctgaacct

SEQ ID NO: 231312 - DNA, 22 bp, Artificial sequence
  SiRNA target sequence
aaggcaccttcttctgaaccta

SEQ ID NO: 231313 - DNA, 22 bp, Artificial sequence
  SiRNA target sequence
aggcaccttcttctgaacctac

SEQ ID NO: 231314 - DNA, 22 bp, Artificial sequence
  SiRNA target sequence
ggcaccttcttctgaacctact

SEQ ID NO: 231315 - DNA, 22 bp, Artificial sequence
  SiRNA target sequence
gcaccttcttctgaacctactg

SEQ ID NO: 231316 - DNA, 22 bp, Artificial sequence
  SiRNA target sequence
caccttcttctgaacctactgt

SEQ ID NO: 231317 - DNA, 22 bp, Artificial sequence
  SiRNA target sequence
accttcttctgaacctactgtt

SEQ ID NO: 231318 - DNA, 22 bp, Artificial sequence
  SiRNA target sequence
ccttcttctgaacctactgttg

SEQ ID NO: 231319 - DNA, 22 bp, Artificial sequence
  SiRNA target sequence
cttcttctgaacctactgttgc

SEQ ID NO: 231320 - DNA, 22 bp, Artificial sequence
  SiRNA target sequence
ttcttctgaacctactgttgct

SEQ ID NO: 231321 - DNA, 22 bp, Artificial sequence
  SiRNA target sequence
tcttctgaacctactgttgcta

SEQ ID NO: 231322 - DNA, 22 bp, Artificial sequence
  SiRNA target sequence
cttctgaacctactgttgctac

SEQ ID NO: 231323 - DNA, 22 bp, Artificial sequence
  SiRNA target sequence
ttctgaacctactgttgctacc

SEQ ID NO: 231324 - DNA, 22 bp, Artificial sequence
  SiRNA target sequence
tctgaacctactgttgctacca

SEQ ID NO: 231325 - DNA, 22 bp, Artificial sequence
  SiRNA target sequence
ctgaacctactgttgctaccaa

SEQ ID NO: 231326 - DNA, 22 bp, Artificial sequence
  SiRNA target sequence
tgaacctactgttgctaccaaa

SEQ ID NO: 231327 - DNA, 22 bp, Artificial sequence
  SiRNA target sequence
gaacctactgttgctaccaaaa

SEQ ID NO: 231328 - DNA, 22 bp, Artificial sequence
  SiRNA target sequence
aacctactgttgctaccaaaag

SEQ ID NO: 231329 - DNA, 22 bp, Artificial sequence
  SiRNA target sequence
acctactgttgctaccaaaagt

SEQ ID NO: 231330 - DNA, 22 bp, Artificial sequence
  SiRNA target sequence
cctactgttgctaccaaaagtg

SEQ ID NO: 231331 - DNA, 22 bp, Artificial sequence
  SiRNA target sequence
ctactgttgctaccaaaagtgt

SEQ ID NO: 231332 - DNA, 22 bp, Artificial sequence
  SiRNA target sequence
tactgttgctaccaaaagtgtt

SEQ ID NO: 231333 - DNA, 22 bp, Artificial sequence
  SiRNA target sequence
actgttgctaccaaaagtgtta

SEQ ID NO: 231334 - DNA, 22 bp, Artificial sequence
  SiRNA target sequence
ctgttgctaccaaaagtgttac

SEQ ID NO: 231335 - DNA, 22 bp, Artificial sequence
  SiRNA target sequence
tgttgctaccaaaagtgttact

SEQ ID NO: 231336 - DNA, 22 bp, Artificial sequence
  SiRNA target sequence
gttgctaccaaaagtgttacta

SEQ ID NO: 231337 - DNA, 22 bp, Artificial sequence
  SiRNA target sequence
ttgctaccaaaagtgttactac

SEQ ID NO: 231338 - DNA, 22 bp, Artificial sequence
  SiRNA target sequence
tgctaccaaaagtgttactaca

SEQ ID NO: 231339 - DNA, 22 bp, Artificial sequence
  SiRNA target sequence
gctaccaaaagtgttactacag

SEQ ID NO: 231340 - DNA, 22 bp, Artificial sequence
  SiRNA target sequence
ctaccaaaagtgttactacaga

SEQ ID NO: 231341 - DNA, 22 bp, Artificial sequence
  SiRNA target sequence
taccaaaagtgttactacagaa

SEQ ID NO: 231342 - DNA, 22 bp, Artificial sequence
  SiRNA target sequence
accaaaagtgttactacagaag

SEQ ID NO: 231343 - DNA, 22 bp, Artificial sequence
  SiRNA target sequence
ccaaaagtgttactacagaaga

SEQ ID NO: 231344 - DNA, 22 bp, Artificial sequence
  SiRNA target sequence
caaaagtgttactacagaagaa

SEQ ID NO: 231345 - DNA, 22 bp, Artificial sequence
  SiRNA target sequence
aaaagtgttactacagaagaat

SEQ ID NO: 231346 - DNA, 22 bp, Artificial sequence
  SiRNA target sequence
aaagtgttactacagaagaata

SEQ ID NO: 231347 - DNA, 22 bp, Artificial sequence
  SiRNA target sequence
aagtgttactacagaagaataa

SEQ ID NO: 231348 - DNA, 23 bp, Artificial sequence
  SiRNA target sequence
atgtcagtagacaattcgaaagt

SEQ ID NO: 231349 - DNA, 23 bp, Artificial sequence
  SiRNA target sequence
tgtcagtagacaattcgaaagtt

SEQ ID NO: 231350 - DNA, 23 bp, Artificial sequence
  SiRNA target sequence
gtcagtagacaattcgaaagttc

SEQ ID NO: 231351 - DNA, 23 bp, Artificial sequence
  SiRNA target sequence
tcagtagacaattcgaaagttct

SEQ ID NO: 231352 - DNA, 23 bp, Artificial sequence
  SiRNA target sequence
cagtagacaattcgaaagttcta

SEQ ID NO: 231353 - DNA, 23 bp, Artificial sequence
  SiRNA target sequence
agtagacaattcgaaagttctac

SEQ ID NO: 231354 - DNA, 23 bp, Artificial sequence
  SiRNA target sequence
gtagacaattcgaaagttctaca

SEQ ID NO: 231355 - DNA, 23 bp, Artificial sequence
  SiRNA target sequence
tagacaattcgaaagttctacaa

SEQ ID NO: 231356 - DNA, 23 bp, Artificial sequence
  SiRNA target sequence
agacaattcgaaagttctacaaa

SEQ ID NO: 231357 - DNA, 23 bp, Artificial sequence
  SiRNA target sequence
gacaattcgaaagttctacaaaa

SEQ ID NO: 231358 - DNA, 23 bp, Artificial sequence
  SiRNA target sequence
acaattcgaaagttctacaaaat

SEQ ID NO: 231359 - DNA, 23 bp, Artificial sequence
  SiRNA target sequence
caattcgaaagttctacaaaata

SEQ ID NO: 231360 - DNA, 23 bp, Artificial sequence
  SiRNA target sequence
aattcgaaagttctacaaaataa

SEQ ID NO: 231361 - DNA, 23 bp, Artificial sequence
  SiRNA target sequence
attcgaaagttctacaaaataac

SEQ ID NO: 231362 - DNA, 23 bp, Artificial sequence
  SiRNA target sequence
ttcgaaagttctacaaaataacg

SEQ ID NO: 231363 - DNA, 23 bp, Artificial sequence
  SiRNA target sequence
tcgaaagttctacaaaataacga

SEQ ID NO: 231364 - DNA, 23 bp, Artificial sequence
  SiRNA target sequence
cgaaagttctacaaaataacgaa

SEQ ID NO: 231365 - DNA, 23 bp, Artificial sequence
  SiRNA target sequence
gaaagttctacaaaataacgaaa

SEQ ID NO: 231366 - DNA, 23 bp, Artificial sequence
  SiRNA target sequence
aaagttctacaaaataacgaaaa

SEQ ID NO: 231367 - DNA, 23 bp, Artificial sequence
  SiRNA target sequence
aagttctacaaaataacgaaaac

SEQ ID NO: 231368 - DNA, 23 bp, Artificial sequence
  SiRNA target sequence
agttctacaaaataacgaaaact

SEQ ID NO: 231369 - DNA, 23 bp, Artificial sequence
  SiRNA target sequence
gttctacaaaataacgaaaactc

SEQ ID NO: 231370 - DNA, 23 bp, Artificial sequence
  SiRNA target sequence
ttctacaaaataacgaaaactct

SEQ ID NO: 231371 - DNA, 23 bp, Artificial sequence
  SiRNA target sequence
tctacaaaataacgaaaactctg

SEQ ID NO: 231372 - DNA, 23 bp, Artificial sequence
  SiRNA target sequence
ctacaaaataacgaaaactctgc

SEQ ID NO: 231373 - DNA, 23 bp, Artificial sequence
  SiRNA target sequence
tacaaaataacgaaaactctgct

SEQ ID NO: 231374 - DNA, 23 bp, Artificial sequence
  SiRNA target sequence
acaaaataacgaaaactctgctc

SEQ ID NO: 231375 - DNA, 23 bp, Artificial sequence
  SiRNA target sequence
caaaataacgaaaactctgctct

SEQ ID NO: 231376 - DNA, 23 bp, Artificial sequence
  SiRNA target sequence
aaaataacgaaaactctgctctt

SEQ ID NO: 231377 - DNA, 23 bp, Artificial sequence
  SiRNA target sequence
aaataacgaaaactctgctcttc

SEQ ID NO: 231378 - DNA, 23 bp, Artificial sequence
  SiRNA target sequence
aataacgaaaactctgctcttcc

SEQ ID NO: 231379 - DNA, 23 bp, Artificial sequence
  SiRNA target sequence
ataacgaaaactctgctcttcct

SEQ ID NO: 231380 - DNA, 23 bp, Artificial sequence
  SiRNA target sequence
taacgaaaactctgctcttccta

SEQ ID NO: 231381 - DNA, 23 bp, Artificial sequence
  SiRNA target sequence
aacgaaaactctgctcttcctac

SEQ ID NO: 231382 - DNA, 23 bp, Artificial sequence
  SiRNA target sequence
acgaaaactctgctcttcctaca

SEQ ID NO: 231383 - DNA, 23 bp, Artificial sequence
  SiRNA target sequence
cgaaaactctgctcttcctacag

SEQ ID NO: 231384 - DNA, 23 bp, Artificial sequence
  SiRNA target sequence
gaaaactctgctcttcctacaga

SEQ ID NO: 231385 - DNA, 23 bp, Artificial sequence
  SiRNA target sequence
aaaactctgctcttcctacagaa

SEQ ID NO: 231386 - DNA, 23 bp, Artificial sequence
  SiRNA target sequence
aaactctgctcttcctacagaag

SEQ ID NO: 231387 - DNA, 23 bp, Artificial sequence
  SiRNA target sequence
aactctgctcttcctacagaaga

SEQ ID NO: 231388 - DNA, 23 bp, Artificial sequence
  SiRNA target sequence
actctgctcttcctacagaagat

SEQ ID NO: 231389 - DNA, 23 bp, Artificial sequence
  SiRNA target sequence
ctctgctcttcctacagaagatg

SEQ ID NO: 231390 - DNA, 23 bp, Artificial sequence
  SiRNA target sequence
tctgctcttcctacagaagatga

SEQ ID NO: 231391 - DNA, 23 bp, Artificial sequence
  SiRNA target sequence
ctgctcttcctacagaagatgaa

SEQ ID NO: 231392 - DNA, 23 bp, Artificial sequence
  SiRNA target sequence
tgctcttcctacagaagatgaaa

SEQ ID NO: 231393 - DNA, 23 bp, Artificial sequence
  SiRNA target sequence
gctcttcctacagaagatgaaat

SEQ ID NO: 231394 - DNA, 23 bp, Artificial sequence
  SiRNA target sequence
ctcttcctacagaagatgaaatt

SEQ ID NO: 231395 - DNA, 23 bp, Artificial sequence
  SiRNA target sequence
tcttcctacagaagatgaaattg

SEQ ID NO: 231396 - DNA, 23 bp, Artificial sequence
  SiRNA target sequence
cttcctacagaagatgaaattga

SEQ ID NO: 231397 - DNA, 23 bp, Artificial sequence
  SiRNA target sequence
ttcctacagaagatgaaattgag

SEQ ID NO: 231398 - DNA, 23 bp, Artificial sequence
  SiRNA target sequence
tcctacagaagatgaaattgagt

SEQ ID NO: 231399 - DNA, 23 bp, Artificial sequence
  SiRNA target sequence
cctacagaagatgaaattgagta

SEQ ID NO: 231400 - DNA, 23 bp, Artificial sequence
  SiRNA target sequence
ctacagaagatgaaattgagtat

SEQ ID NO: 231401 - DNA, 23 bp, Artificial sequence
  SiRNA target sequence
tacagaagatgaaattgagtatg

SEQ ID NO: 231402 - DNA, 23 bp, Artificial sequence
  SiRNA target sequence
acagaagatgaaattgagtatga

SEQ ID NO: 231403 - DNA, 23 bp, Artificial sequence
  SiRNA target sequence
cagaagatgaaattgagtatgag

SEQ ID NO: 231404 - DNA, 23 bp, Artificial sequence
  SiRNA target sequence
agaagatgaaattgagtatgagg

SEQ ID NO: 231405 - DNA, 23 bp, Artificial sequence
  SiRNA target sequence
gaagatgaaattgagtatgaggc

SEQ ID NO: 231406 - DNA, 23 bp, Artificial sequence
  SiRNA target sequence
aagatgaaattgagtatgaggcc

SEQ ID NO: 231407 - DNA, 23 bp, Artificial sequence
  SiRNA target sequence
agatgaaattgagtatgaggcca

SEQ ID NO: 231408 - DNA, 23 bp, Artificial sequence
  SiRNA target sequence
gatgaaattgagtatgaggccag

SEQ ID NO: 231409 - DNA, 23 bp, Artificial sequence
  SiRNA target sequence
atgaaattgagtatgaggccagc

SEQ ID NO: 231410 - DNA, 23 bp, Artificial sequence
  SiRNA target sequence
tgaaattgagtatgaggccagca

SEQ ID NO: 231411 - DNA, 23 bp, Artificial sequence
  SiRNA target sequence
gaaattgagtatgaggccagcaa

SEQ ID NO: 231412 - DNA, 23 bp, Artificial sequence
  SiRNA target sequence
aaattgagtatgaggccagcaat

SEQ ID NO: 231413 - DNA, 23 bp, Artificial sequence
  SiRNA target sequence
aattgagtatgaggccagcaatg

SEQ ID NO: 231414 - DNA, 23 bp, Artificial sequence
  SiRNA target sequence
attgagtatgaggccagcaatgg

SEQ ID NO: 231415 - DNA, 23 bp, Artificial sequence
  SiRNA target sequence
ttgagtatgaggccagcaatggt

SEQ ID NO: 231416 - DNA, 23 bp, Artificial sequence
  SiRNA target sequence
tgagtatgaggccagcaatggtt

SEQ ID NO: 231417 - DNA, 23 bp, Artificial sequence
  SiRNA target sequence
gagtatgaggccagcaatggttc

SEQ ID NO: 231418 - DNA, 23 bp, Artificial sequence
  SiRNA target sequence
agtatgaggccagcaatggttct

SEQ ID NO: 231419 - DNA, 23 bp, Artificial sequence
  SiRNA target sequence
gtatgaggccagcaatggttctg

SEQ ID NO: 231420 - DNA, 23 bp, Artificial sequence
  SiRNA target sequence
tatgaggccagcaatggttctgg

SEQ ID NO: 231421 - DNA, 23 bp, Artificial sequence
  SiRNA target sequence
atgaggccagcaatggttctggt

SEQ ID NO: 231422 - DNA, 23 bp, Artificial sequence
  SiRNA target sequence
tgaggccagcaatggttctggta

SEQ ID NO: 231423 - DNA, 23 bp, Artificial sequence
  SiRNA target sequence
gaggccagcaatggttctggtat

SEQ ID NO: 231424 - DNA, 23 bp, Artificial sequence
  SiRNA target sequence
aggccagcaatggttctggtata

SEQ ID NO: 231425 - DNA, 23 bp, Artificial sequence
  SiRNA target sequence
ggccagcaatggttctggtatat

SEQ ID NO: 231426 - DNA, 23 bp, Artificial sequence
  SiRNA target sequence
gccagcaatggttctggtatata

SEQ ID NO: 231427 - DNA, 23 bp, Artificial sequence
  SiRNA target sequence
ccagcaatggttctggtatatat

SEQ ID NO: 231428 - DNA, 23 bp, Artificial sequence
  SiRNA target sequence
cagcaatggttctggtatatatt

SEQ ID NO: 231429 - DNA, 23 bp, Artificial sequence
  SiRNA target sequence
agcaatggttctggtatatattc

SEQ ID NO: 231430 - DNA, 23 bp, Artificial sequence
  SiRNA target sequence
gcaatggttctggtatatattca

SEQ ID NO: 231431 - DNA, 23 bp, Artificial sequence
  SiRNA target sequence
caatggttctggtatatattcac

SEQ ID NO: 231432 - DNA, 23 bp, Artificial sequence
  SiRNA target sequence
aatggttctggtatatattcact

SEQ ID NO: 231433 - DNA, 23 bp, Artificial sequence
  SiRNA target sequence
atggttctggtatatattcactt

SEQ ID NO: 231434 - DNA, 23 bp, Artificial sequence
  SiRNA target sequence
tggttctggtatatattcactta

SEQ ID NO: 231435 - DNA, 23 bp, Artificial sequence
  SiRNA target sequence
ggttctggtatatattcacttat

SEQ ID NO: 231436 - DNA, 23 bp, Artificial sequence
  SiRNA target sequence
gttctggtatatattcacttatt

SEQ ID NO: 231437 - DNA, 23 bp, Artificial sequence
  SiRNA target sequence
ttctggtatatattcacttatta

SEQ ID NO: 231438 - DNA, 23 bp, Artificial sequence
  SiRNA target sequence
tctggtatatattcacttattag

SEQ ID NO: 231439 - DNA, 23 bp, Artificial sequence
  SiRNA target sequence
ctggtatatattcacttattaga

SEQ ID NO: 231440 - DNA, 23 bp, Artificial sequence
  SiRNA target sequence
tggtatatattcacttattagag

SEQ ID NO: 231441 - DNA, 23 bp, Artificial sequence
  SiRNA target sequence
ggtatatattcacttattagagt

SEQ ID NO: 231442 - DNA, 23 bp, Artificial sequence
  SiRNA target sequence
gtatatattcacttattagagta

SEQ ID NO: 231443 - DNA, 23 bp, Artificial sequence
  SiRNA target sequence
tatatattcacttattagagtag

SEQ ID NO: 231444 - DNA, 23 bp, Artificial sequence
  SiRNA target sequence
atatattcacttattagagtagc

SEQ ID NO: 231445 - DNA, 23 bp, Artificial sequence
  SiRNA target sequence
tatattcacttattagagtagca

SEQ ID NO: 231446 - DNA, 23 bp, Artificial sequence
  SiRNA target sequence
atattcacttattagagtagcaa

SEQ ID NO: 231447 - DNA, 23 bp, Artificial sequence
  SiRNA target sequence
tattcacttattagagtagcaaa

SEQ ID NO: 231448 - DNA, 23 bp, Artificial sequence
  SiRNA target sequence
attcacttattagagtagcaaag

SEQ ID NO: 231449 - DNA, 23 bp, Artificial sequence
  SiRNA target sequence
ttcacttattagagtagcaaagg

SEQ ID NO: 231450 - DNA, 23 bp, Artificial sequence
  SiRNA target sequence
tcacttattagagtagcaaaggt

SEQ ID NO: 231451 - DNA, 23 bp, Artificial sequence
  SiRNA target sequence
cacttattagagtagcaaaggtt

SEQ ID NO: 231452 - DNA, 23 bp, Artificial sequence
  SiRNA target sequence
acttattagagtagcaaaggttg

SEQ ID NO: 231453 - DNA, 23 bp, Artificial sequence
  SiRNA target sequence
cttattagagtagcaaaggttga

SEQ ID NO: 231454 - DNA, 23 bp, Artificial sequence
  SiRNA target sequence
ttattagagtagcaaaggttgag

SEQ ID NO: 231455 - DNA, 23 bp, Artificial sequence
  SiRNA target sequence
tattagagtagcaaaggttgaga

SEQ ID NO: 231456 - DNA, 23 bp, Artificial sequence
  SiRNA target sequence
attagagtagcaaaggttgagag

SEQ ID NO: 231457 - DNA, 23 bp, Artificial sequence
  SiRNA target sequence
ttagagtagcaaaggttgagaga

SEQ ID NO: 231458 - DNA, 23 bp, Artificial sequence
  SiRNA target sequence
tagagtagcaaaggttgagagaa

SEQ ID NO: 231459 - DNA, 23 bp, Artificial sequence
  SiRNA target sequence
agagtagcaaaggttgagagaaa

SEQ ID NO: 231460 - DNA, 23 bp, Artificial sequence
  SiRNA target sequence
gagtagcaaaggttgagagaaag

SEQ ID NO: 231461 - DNA, 23 bp, Artificial sequence
  SiRNA target sequence
agtagcaaaggttgagagaaaga

SEQ ID NO: 231462 - DNA, 23 bp, Artificial sequence
  SiRNA target sequence
gtagcaaaggttgagagaaagat

SEQ ID NO: 231463 - DNA, 23 bp, Artificial sequence
  SiRNA target sequence
tagcaaaggttgagagaaagatg

SEQ ID NO: 231464 - DNA, 23 bp, Artificial sequence
  SiRNA target sequence
agcaaaggttgagagaaagatgt

SEQ ID NO: 231465 - DNA, 23 bp, Artificial sequence
  SiRNA target sequence
gcaaaggttgagagaaagatgtt

SEQ ID NO: 231466 - DNA, 23 bp, Artificial sequence
  SiRNA target sequence
caaaggttgagagaaagatgttt

SEQ ID NO: 231467 - DNA, 23 bp, Artificial sequence
  SiRNA target sequence
aaaggttgagagaaagatgtttt

SEQ ID NO: 231468 - DNA, 23 bp, Artificial sequence
  SiRNA target sequence
aaggttgagagaaagatgttttg

SEQ ID NO: 231469 - DNA, 23 bp, Artificial sequence
  SiRNA target sequence
aggttgagagaaagatgttttgg

SEQ ID NO: 231470 - DNA, 23 bp, Artificial sequence
  SiRNA target sequence
ggttgagagaaagatgttttgga

SEQ ID NO: 231471 - DNA, 23 bp, Artificial sequence
  SiRNA target sequence
gttgagagaaagatgttttggat

SEQ ID NO: 231472 - DNA, 23 bp, Artificial sequence
  SiRNA target sequence
ttgagagaaagatgttttggatc

SEQ ID NO: 231473 - DNA, 23 bp, Artificial sequence
  SiRNA target sequence
tgagagaaagatgttttggatca

SEQ ID NO: 231474 - DNA, 23 bp, Artificial sequence
  SiRNA target sequence
gagagaaagatgttttggatcat

SEQ ID NO: 231475 - DNA, 23 bp, Artificial sequence
  SiRNA target sequence
agagaaagatgttttggatcatg

SEQ ID NO: 231476 - DNA, 23 bp, Artificial sequence
  SiRNA target sequence
gagaaagatgttttggatcatgg

SEQ ID NO: 231477 - DNA, 23 bp, Artificial sequence
  SiRNA target sequence
agaaagatgttttggatcatggc

SEQ ID NO: 231478 - DNA, 23 bp, Artificial sequence
  SiRNA target sequence
gaaagatgttttggatcatggca

SEQ ID NO: 231479 - DNA, 23 bp, Artificial sequence
  SiRNA target sequence
aaagatgttttggatcatggcag

SEQ ID NO: 231480 - DNA, 23 bp, Artificial sequence
  SiRNA target sequence
aagatgttttggatcatggcagc

SEQ ID NO: 231481 - DNA, 23 bp, Artificial sequence
  SiRNA target sequence
agatgttttggatcatggcagct

SEQ ID NO: 231482 - DNA, 23 bp, Artificial sequence
  SiRNA target sequence
gatgttttggatcatggcagcta

SEQ ID NO: 231483 - DNA, 23 bp, Artificial sequence
  SiRNA target sequence
atgttttggatcatggcagctat

SEQ ID NO: 231484 - DNA, 23 bp, Artificial sequence
  SiRNA target sequence
tgttttggatcatggcagctatg

SEQ ID NO: 231485 - DNA, 23 bp, Artificial sequence
  SiRNA target sequence
gttttggatcatggcagctatgt

SEQ ID NO: 231486 - DNA, 23 bp, Artificial sequence
  SiRNA target sequence
ttttggatcatggcagctatgtt

SEQ ID NO: 231487 - DNA, 23 bp, Artificial sequence
  SiRNA target sequence
tttggatcatggcagctatgttc

SEQ ID NO: 231488 - DNA, 23 bp, Artificial sequence
  SiRNA target sequence
ttggatcatggcagctatgttct

SEQ ID NO: 231489 - DNA, 23 bp, Artificial sequence
  SiRNA target sequence
tggatcatggcagctatgttctt

SEQ ID NO: 231490 - DNA, 23 bp, Artificial sequence
  SiRNA target sequence
ggatcatggcagctatgttcttt

SEQ ID NO: 231491 - DNA, 23 bp, Artificial sequence
  SiRNA target sequence
gatcatggcagctatgttcttta

SEQ ID NO: 231492 - DNA, 23 bp, Artificial sequence
  SiRNA target sequence
atcatggcagctatgttctttat

SEQ ID NO: 231493 - DNA, 23 bp, Artificial sequence
  SiRNA target sequence
tcatggcagctatgttctttatt

SEQ ID NO: 231494 - DNA, 23 bp, Artificial sequence
  SiRNA target sequence
catggcagctatgttctttatta

SEQ ID NO: 231495 - DNA, 23 bp, Artificial sequence
  SiRNA target sequence
atggcagctatgttctttattat

SEQ ID NO: 231496 - DNA, 23 bp, Artificial sequence
  SiRNA target sequence
tggcagctatgttctttattatc

SEQ ID NO: 231497 - DNA, 23 bp, Artificial sequence
  SiRNA target sequence
ggcagctatgttctttattatct

SEQ ID NO: 231498 - DNA, 23 bp, Artificial sequence
  SiRNA target sequence
gcagctatgttctttattatctc

SEQ ID NO: 231499 - DNA, 23 bp, Artificial sequence
  SiRNA target sequence
cagctatgttctttattatctcc

SEQ ID NO: 231500 - DNA, 23 bp, Artificial sequence
  SiRNA target sequence
agctatgttctttattatctcct

SEQ ID NO: 231501 - DNA, 23 bp, Artificial sequence
  SiRNA target sequence
gctatgttctttattatctcctt

SEQ ID NO: 231502 - DNA, 23 bp, Artificial sequence
  SiRNA target sequence
ctatgttctttattatctccttt

SEQ ID NO: 231503 - DNA, 23 bp, Artificial sequence
  SiRNA target sequence
tatgttctttattatctccttta

SEQ ID NO: 231504 - DNA, 23 bp, Artificial sequence
  SiRNA target sequence
atgttctttattatctcctttat

SEQ ID NO: 231505 - DNA, 23 bp, Artificial sequence
  SiRNA target sequence
tgttctttattatctcctttatt

SEQ ID NO: 231506 - DNA, 23 bp, Artificial sequence
  SiRNA target sequence
gttctttattatctcctttattt

SEQ ID NO: 231507 - DNA, 23 bp, Artificial sequence
  SiRNA target sequence
ttctttattatctcctttattta

SEQ ID NO: 231508 - DNA, 23 bp, Artificial sequence
  SiRNA target sequence
tctttattatctcctttatttat

SEQ ID NO: 231509 - DNA, 23 bp, Artificial sequence
  SiRNA target sequence
ctttattatctcctttatttatt

SEQ ID NO: 231510 - DNA, 23 bp, Artificial sequence
  SiRNA target sequence
tttattatctcctttatttattc

SEQ ID NO: 231511 - DNA, 23 bp, Artificial sequence
  SiRNA target sequence
ttattatctcctttatttattcg

SEQ ID NO: 231512 - DNA, 23 bp, Artificial sequence
  SiRNA target sequence
tattatctcctttatttattcgg

SEQ ID NO: 231513 - DNA, 23 bp, Artificial sequence
  SiRNA target sequence
attatctcctttatttattcggt

SEQ ID NO: 231514 - DNA, 23 bp, Artificial sequence
  SiRNA target sequence
ttatctcctttatttattcggtg

SEQ ID NO: 231515 - DNA, 23 bp, Artificial sequence
  SiRNA target sequence
tatctcctttatttattcggtgg

SEQ ID NO: 231516 - DNA, 23 bp, Artificial sequence
  SiRNA target sequence
atctcctttatttattcggtggc

SEQ ID NO: 231517 - DNA, 23 bp, Artificial sequence
  SiRNA target sequence
tctcctttatttattcggtggct

SEQ ID NO: 231518 - DNA, 23 bp, Artificial sequence
  SiRNA target sequence
ctcctttatttattcggtggcta

SEQ ID NO: 231519 - DNA, 23 bp, Artificial sequence
  SiRNA target sequence
tcctttatttattcggtggctag

SEQ ID NO: 231520 - DNA, 23 bp, Artificial sequence
  SiRNA target sequence
cctttatttattcggtggctaga

SEQ ID NO: 231521 - DNA, 23 bp, Artificial sequence
  SiRNA target sequence
ctttatttattcggtggctagag

SEQ ID NO: 231522 - DNA, 23 bp, Artificial sequence
  SiRNA target sequence
tttatttattcggtggctagagt

SEQ ID NO: 231523 - DNA, 23 bp, Artificial sequence
  SiRNA target sequence
ttatttattcggtggctagagtg

SEQ ID NO: 231524 - DNA, 23 bp, Artificial sequence
  SiRNA target sequence
tatttattcggtggctagagtgc

SEQ ID NO: 231525 - DNA, 23 bp, Artificial sequence
  SiRNA target sequence
atttattcggtggctagagtgct

SEQ ID NO: 231526 - DNA, 23 bp, Artificial sequence
  SiRNA target sequence
tttattcggtggctagagtgctt

SEQ ID NO: 231527 - DNA, 23 bp, Artificial sequence
  SiRNA target sequence
ttattcggtggctagagtgctta

SEQ ID NO: 231528 - DNA, 23 bp, Artificial sequence
  SiRNA target sequence
tattcggtggctagagtgcttaa

SEQ ID NO: 231529 - DNA, 23 bp, Artificial sequence
  SiRNA target sequence
attcggtggctagagtgcttaaa

SEQ ID NO: 231530 - DNA, 23 bp, Artificial sequence
  SiRNA target sequence
ttcggtggctagagtgcttaaag

SEQ ID NO: 231531 - DNA, 23 bp, Artificial sequence
  SiRNA target sequence
tcggtggctagagtgcttaaaga

SEQ ID NO: 231532 - DNA, 23 bp, Artificial sequence
  SiRNA target sequence
cggtggctagagtgcttaaagat

SEQ ID NO: 231533 - DNA, 23 bp, Artificial sequence
  SiRNA target sequence
ggtggctagagtgcttaaagatg

SEQ ID NO: 231534 - DNA, 23 bp, Artificial sequence
  SiRNA target sequence
gtggctagagtgcttaaagatgc

SEQ ID NO: 231535 - DNA, 23 bp, Artificial sequence
  SiRNA target sequence
tggctagagtgcttaaagatgcc

SEQ ID NO: 231536 - DNA, 23 bp, Artificial sequence
  SiRNA target sequence
ggctagagtgcttaaagatgccg

SEQ ID NO: 231537 - DNA, 23 bp, Artificial sequence
  SiRNA target sequence
gctagagtgcttaaagatgccgc

SEQ ID NO: 231538 - DNA, 23 bp, Artificial sequence
  SiRNA target sequence
ctagagtgcttaaagatgccgct

SEQ ID NO: 231539 - DNA, 23 bp, Artificial sequence
  SiRNA target sequence
tagagtgcttaaagatgccgctg

SEQ ID NO: 231540 - DNA, 23 bp, Artificial sequence
  SiRNA target sequence
agagtgcttaaagatgccgctgt

SEQ ID NO: 231541 - DNA, 23 bp, Artificial sequence
  SiRNA target sequence
gagtgcttaaagatgccgctgtt

SEQ ID NO: 231542 - DNA, 23 bp, Artificial sequence
  SiRNA target sequence
agtgcttaaagatgccgctgtta

SEQ ID NO: 231543 - DNA, 23 bp, Artificial sequence
  SiRNA target sequence
gtgcttaaagatgccgctgttat

SEQ ID NO: 231544 - DNA, 23 bp, Artificial sequence
  SiRNA target sequence
tgcttaaagatgccgctgttatt

SEQ ID NO: 231545 - DNA, 23 bp, Artificial sequence
  SiRNA target sequence
gcttaaagatgccgctgttattg

SEQ ID NO: 231546 - DNA, 23 bp, Artificial sequence
  SiRNA target sequence
cttaaagatgccgctgttattgg

SEQ ID NO: 231547 - DNA, 23 bp, Artificial sequence
  SiRNA target sequence
ttaaagatgccgctgttattggt

SEQ ID NO: 231548 - DNA, 23 bp, Artificial sequence
  SiRNA target sequence
taaagatgccgctgttattggta

SEQ ID NO: 231549 - DNA, 23 bp, Artificial sequence
  SiRNA target sequence
aaagatgccgctgttattggtaa

SEQ ID NO: 231550 - DNA, 23 bp, Artificial sequence
  SiRNA target sequence
aagatgccgctgttattggtaaa

SEQ ID NO: 231551 - DNA, 23 bp, Artificial sequence
  SiRNA target sequence
agatgccgctgttattggtaaac

SEQ ID NO: 231552 - DNA, 23 bp, Artificial sequence
  SiRNA target sequence
gatgccgctgttattggtaaaca

SEQ ID NO: 231553 - DNA, 23 bp, Artificial sequence
  SiRNA target sequence
atgccgctgttattggtaaacaa

SEQ ID NO: 231554 - DNA, 23 bp, Artificial sequence
  SiRNA target sequence
tgccgctgttattggtaaacaac

SEQ ID NO: 231555 - DNA, 23 bp, Artificial sequence
  SiRNA target sequence
gccgctgttattggtaaacaact

SEQ ID NO: 231556 - DNA, 23 bp, Artificial sequence
  SiRNA target sequence
ccgctgttattggtaaacaactc

SEQ ID NO: 231557 - DNA, 23 bp, Artificial sequence
  SiRNA target sequence
cgctgttattggtaaacaactcc

SEQ ID NO: 231558 - DNA, 23 bp, Artificial sequence
  SiRNA target sequence
gctgttattggtaaacaactccc

SEQ ID NO: 231559 - DNA, 23 bp, Artificial sequence
  SiRNA target sequence
ctgttattggtaaacaactccca

SEQ ID NO: 231560 - DNA, 23 bp, Artificial sequence
  SiRNA target sequence
tgttattggtaaacaactcccag

SEQ ID NO: 231561 - DNA, 23 bp, Artificial sequence
  SiRNA target sequence
gttattggtaaacaactcccagc

SEQ ID NO: 231562 - DNA, 23 bp, Artificial sequence
  SiRNA target sequence
ttattggtaaacaactcccagcg

SEQ ID NO: 231563 - DNA, 23 bp, Artificial sequence
  SiRNA target sequence
tattggtaaacaactcccagcgt

SEQ ID NO: 231564 - DNA, 23 bp, Artificial sequence
  SiRNA target sequence
attggtaaacaactcccagcgtc

SEQ ID NO: 231565 - DNA, 23 bp, Artificial sequence
  SiRNA target sequence
ttggtaaacaactcccagcgtca

SEQ ID NO: 231566 - DNA, 23 bp, Artificial sequence
  SiRNA target sequence
tggtaaacaactcccagcgtcaa

SEQ ID NO: 231567 - DNA, 23 bp, Artificial sequence
  SiRNA target sequence
ggtaaacaactcccagcgtcaat

SEQ ID NO: 231568 - DNA, 23 bp, Artificial sequence
  SiRNA target sequence
gtaaacaactcccagcgtcaatt

SEQ ID NO: 231569 - DNA, 23 bp, Artificial sequence
  SiRNA target sequence
taaacaactcccagcgtcaattt

SEQ ID NO: 231570 - DNA, 23 bp, Artificial sequence
  SiRNA target sequence
aaacaactcccagcgtcaatttt

SEQ ID NO: 231571 - DNA, 23 bp, Artificial sequence
  SiRNA target sequence
aacaactcccagcgtcaattttc

SEQ ID NO: 231572 - DNA, 23 bp, Artificial sequence
  SiRNA target sequence
acaactcccagcgtcaattttct

SEQ ID NO: 231573 - DNA, 23 bp, Artificial sequence
  SiRNA target sequence
caactcccagcgtcaattttctt

SEQ ID NO: 231574 - DNA, 23 bp, Artificial sequence
  SiRNA target sequence
aactcccagcgtcaattttcttt

SEQ ID NO: 231575 - DNA, 23 bp, Artificial sequence
  SiRNA target sequence
actcccagcgtcaattttctttt

SEQ ID NO: 231576 - DNA, 23 bp, Artificial sequence
  SiRNA target sequence
ctcccagcgtcaattttcttttt

SEQ ID NO: 231577 - DNA, 23 bp, Artificial sequence
  SiRNA target sequence
tcccagcgtcaattttctttttg

SEQ ID NO: 231578 - DNA, 23 bp, Artificial sequence
  SiRNA target sequence
cccagcgtcaattttctttttga

SEQ ID NO: 231579 - DNA, 23 bp, Artificial sequence
  SiRNA target sequence
ccagcgtcaattttctttttgaa

SEQ ID NO: 231580 - DNA, 23 bp, Artificial sequence
  SiRNA target sequence
cagcgtcaattttctttttgaaa

SEQ ID NO: 231581 - DNA, 23 bp, Artificial sequence
  SiRNA target sequence
agcgtcaattttctttttgaaat

SEQ ID NO: 231582 - DNA, 23 bp, Artificial sequence
  SiRNA target sequence
gcgtcaattttctttttgaaatt

SEQ ID NO: 231583 - DNA, 23 bp, Artificial sequence
  SiRNA target sequence
cgtcaattttctttttgaaattt

SEQ ID NO: 231584 - DNA, 23 bp, Artificial sequence
  SiRNA target sequence
gtcaattttctttttgaaatttg

SEQ ID NO: 231585 - DNA, 23 bp, Artificial sequence
  SiRNA target sequence
tcaattttctttttgaaatttgt

SEQ ID NO: 231586 - DNA, 23 bp, Artificial sequence
  SiRNA target sequence
caattttctttttgaaatttgtt

SEQ ID NO: 231587 - DNA, 23 bp, Artificial sequence
  SiRNA target sequence
aattttctttttgaaatttgtta

SEQ ID NO: 231588 - DNA, 23 bp, Artificial sequence
  SiRNA target sequence
attttctttttgaaatttgttat

SEQ ID NO: 231589 - DNA, 23 bp, Artificial sequence
  SiRNA target sequence
ttttctttttgaaatttgttatt

SEQ ID NO: 231590 - DNA, 23 bp, Artificial sequence
  SiRNA target sequence
tttctttttgaaatttgttatta

SEQ ID NO: 231591 - DNA, 23 bp, Artificial sequence
  SiRNA target sequence
ttctttttgaaatttgttattat

SEQ ID NO: 231592 - DNA, 23 bp, Artificial sequence
  SiRNA target sequence
tctttttgaaatttgttattatc

SEQ ID NO: 231593 - DNA, 23 bp, Artificial sequence
  SiRNA target sequence
ctttttgaaatttgttattatcc

SEQ ID NO: 231594 - DNA, 23 bp, Artificial sequence
  SiRNA target sequence
tttttgaaatttgttattatcct

SEQ ID NO: 231595 - DNA, 23 bp, Artificial sequence
  SiRNA target sequence
ttttgaaatttgttattatcctt

SEQ ID NO: 231596 - DNA, 23 bp, Artificial sequence
  SiRNA target sequence
tttgaaatttgttattatccttc

SEQ ID NO: 231597 - DNA, 23 bp, Artificial sequence
  SiRNA target sequence
ttgaaatttgttattatccttcc

SEQ ID NO: 231598 - DNA, 23 bp, Artificial sequence
  SiRNA target sequence
tgaaatttgttattatccttccg

SEQ ID NO: 231599 - DNA, 23 bp, Artificial sequence
  SiRNA target sequence
gaaatttgttattatccttccgt

SEQ ID NO: 231600 - DNA, 23 bp, Artificial sequence
  SiRNA target sequence
aaatttgttattatccttccgtt

SEQ ID NO: 231601 - DNA, 23 bp, Artificial sequence
  SiRNA target sequence
aatttgttattatccttccgttc

SEQ ID NO: 231602 - DNA, 23 bp, Artificial sequence
  SiRNA target sequence
atttgttattatccttccgttct

SEQ ID NO: 231603 - DNA, 23 bp, Artificial sequence
  SiRNA target sequence
tttgttattatccttccgttctc

SEQ ID NO: 231604 - DNA, 23 bp, Artificial sequence
  SiRNA target sequence
ttgttattatccttccgttctca

SEQ ID NO: 231605 - DNA, 23 bp, Artificial sequence
  SiRNA target sequence
tgttattatccttccgttctcat

SEQ ID NO: 231606 - DNA, 23 bp, Artificial sequence
  SiRNA target sequence
gttattatccttccgttctcatt

SEQ ID NO: 231607 - DNA, 23 bp, Artificial sequence
  SiRNA target sequence
ttattatccttccgttctcattt

SEQ ID NO: 231608 - DNA, 23 bp, Artificial sequence
  SiRNA target sequence
tattatccttccgttctcattta

SEQ ID NO: 231609 - DNA, 23 bp, Artificial sequence
  SiRNA target sequence
attatccttccgttctcatttat

SEQ ID NO: 231610 - DNA, 23 bp, Artificial sequence
  SiRNA target sequence
ttatccttccgttctcatttatt

SEQ ID NO: 231611 - DNA, 23 bp, Artificial sequence
  SiRNA target sequence
tatccttccgttctcatttattt

SEQ ID NO: 231612 - DNA, 23 bp, Artificial sequence
  SiRNA target sequence
atccttccgttctcatttatttc

SEQ ID NO: 231613 - DNA, 23 bp, Artificial sequence
  SiRNA target sequence
tccttccgttctcatttatttca

SEQ ID NO: 231614 - DNA, 23 bp, Artificial sequence
  SiRNA target sequence
ccttccgttctcatttatttcag

SEQ ID NO: 231615 - DNA, 23 bp, Artificial sequence
  SiRNA target sequence
cttccgttctcatttatttcagt

SEQ ID NO: 231616 - DNA, 23 bp, Artificial sequence
  SiRNA target sequence
ttccgttctcatttatttcagta

SEQ ID NO: 231617 - DNA, 23 bp, Artificial sequence
  SiRNA target sequence
tccgttctcatttatttcagtag

SEQ ID NO: 231618 - DNA, 23 bp, Artificial sequence
  SiRNA target sequence
ccgttctcatttatttcagtagg

SEQ ID NO: 231619 - DNA, 23 bp, Artificial sequence
  SiRNA target sequence
cgttctcatttatttcagtaggt

SEQ ID NO: 231620 - DNA, 23 bp, Artificial sequence
  SiRNA target sequence
gttctcatttatttcagtaggta

SEQ ID NO: 231621 - DNA, 23 bp, Artificial sequence
  SiRNA target sequence
ttctcatttatttcagtaggtat

SEQ ID NO: 231622 - DNA, 23 bp, Artificial sequence
  SiRNA target sequence
tctcatttatttcagtaggtatt

SEQ ID NO: 231623 - DNA, 23 bp, Artificial sequence
  SiRNA target sequence
ctcatttatttcagtaggtatta

SEQ ID NO: 231624 - DNA, 23 bp, Artificial sequence
  SiRNA target sequence
tcatttatttcagtaggtattat

SEQ ID NO: 231625 - DNA, 23 bp, Artificial sequence
  SiRNA target sequence
catttatttcagtaggtattatt

SEQ ID NO: 231626 - DNA, 23 bp, Artificial sequence
  SiRNA target sequence
atttatttcagtaggtattattc

SEQ ID NO: 231627 - DNA, 23 bp, Artificial sequence
  SiRNA target sequence
tttatttcagtaggtattattca

SEQ ID NO: 231628 - DNA, 23 bp, Artificial sequence
  SiRNA target sequence
ttatttcagtaggtattattcag

SEQ ID NO: 231629 - DNA, 23 bp, Artificial sequence
  SiRNA target sequence
tatttcagtaggtattattcaga

SEQ ID NO: 231630 - DNA, 23 bp, Artificial sequence
  SiRNA target sequence
atttcagtaggtattattcagaa

SEQ ID NO: 231631 - DNA, 23 bp, Artificial sequence
  SiRNA target sequence
tttcagtaggtattattcagaaa

SEQ ID NO: 231632 - DNA, 23 bp, Artificial sequence
  SiRNA target sequence
ttcagtaggtattattcagaaag

SEQ ID NO: 231633 - DNA, 23 bp, Artificial sequence
  SiRNA target sequence
tcagtaggtattattcagaaagc

SEQ ID NO: 231634 - DNA, 23 bp, Artificial sequence
  SiRNA target sequence
cagtaggtattattcagaaagct

SEQ ID NO: 231635 - DNA, 23 bp, Artificial sequence
  SiRNA target sequence
agtaggtattattcagaaagctt

SEQ ID NO: 231636 - DNA, 23 bp, Artificial sequence
  SiRNA target sequence
gtaggtattattcagaaagcttt

SEQ ID NO: 231637 - DNA, 23 bp, Artificial sequence
  SiRNA target sequence
taggtattattcagaaagcttta

SEQ ID NO: 231638 - DNA, 23 bp, Artificial sequence
  SiRNA target sequence
aggtattattcagaaagctttag

SEQ ID NO: 231639 - DNA, 23 bp, Artificial sequence
  SiRNA target sequence
ggtattattcagaaagctttaga

SEQ ID NO: 231640 - DNA, 23 bp, Artificial sequence
  SiRNA target sequence
gtattattcagaaagctttagat

SEQ ID NO: 231641 - DNA, 23 bp, Artificial sequence
  SiRNA target sequence
tattattcagaaagctttagata

SEQ ID NO: 231642 - DNA, 23 bp, Artificial sequence
  SiRNA target sequence
attattcagaaagctttagataa

SEQ ID NO: 231643 - DNA, 23 bp, Artificial sequence
  SiRNA target sequence
ttattcagaaagctttagataaa

SEQ ID NO: 231644 - DNA, 23 bp, Artificial sequence
  SiRNA target sequence
tattcagaaagctttagataaat

SEQ ID NO: 231645 - DNA, 23 bp, Artificial sequence
  SiRNA target sequence
attcagaaagctttagataaata

SEQ ID NO: 231646 - DNA, 23 bp, Artificial sequence
  SiRNA target sequence
ttcagaaagctttagataaatat

SEQ ID NO: 231647 - DNA, 23 bp, Artificial sequence
  SiRNA target sequence
tcagaaagctttagataaatatc

SEQ ID NO: 231648 - DNA, 23 bp, Artificial sequence
  SiRNA target sequence
cagaaagctttagataaatatcc

SEQ ID NO: 231649 - DNA, 23 bp, Artificial sequence
  SiRNA target sequence
agaaagctttagataaatatcct

SEQ ID NO: 231650 - DNA, 23 bp, Artificial sequence
  SiRNA target sequence
gaaagctttagataaatatcctt

SEQ ID NO: 231651 - DNA, 23 bp, Artificial sequence
  SiRNA target sequence
aaagctttagataaatatccttt

SEQ ID NO: 231652 - DNA, 23 bp, Artificial sequence
  SiRNA target sequence
aagctttagataaatatcctttt

SEQ ID NO: 231653 - DNA, 23 bp, Artificial sequence
  SiRNA target sequence
agctttagataaatatcctttta

SEQ ID NO: 231654 - DNA, 23 bp, Artificial sequence
  SiRNA target sequence
gctttagataaatatccttttac

SEQ ID NO: 231655 - DNA, 23 bp, Artificial sequence
  SiRNA target sequence
ctttagataaatatccttttaca

SEQ ID NO: 231656 - DNA, 23 bp, Artificial sequence
  SiRNA target sequence
tttagataaatatccttttacaa

SEQ ID NO: 231657 - DNA, 23 bp, Artificial sequence
  SiRNA target sequence
ttagataaatatccttttacaaa

SEQ ID NO: 231658 - DNA, 23 bp, Artificial sequence
  SiRNA target sequence
tagataaatatccttttacaaaa

SEQ ID NO: 231659 - DNA, 23 bp, Artificial sequence
  SiRNA target sequence
agataaatatccttttacaaaaa

SEQ ID NO: 231660 - DNA, 23 bp, Artificial sequence
  SiRNA target sequence
gataaatatccttttacaaaaat

SEQ ID NO: 231661 - DNA, 23 bp, Artificial sequence
  SiRNA target sequence
ataaatatccttttacaaaaata

SEQ ID NO: 231662 - DNA, 23 bp, Artificial sequence
  SiRNA target sequence
taaatatccttttacaaaaatat

SEQ ID NO: 231663 - DNA, 23 bp, Artificial sequence
  SiRNA target sequence
aaatatccttttacaaaaatatt

SEQ ID NO: 231664 - DNA, 23 bp, Artificial sequence
  SiRNA target sequence
aatatccttttacaaaaatattt

SEQ ID NO: 231665 - DNA, 23 bp, Artificial sequence
  SiRNA target sequence
atatccttttacaaaaatatttg

SEQ ID NO: 231666 - DNA, 23 bp, Artificial sequence
  SiRNA target sequence
tatccttttacaaaaatatttga

SEQ ID NO: 231667 - DNA, 23 bp, Artificial sequence
  SiRNA target sequence
atccttttacaaaaatatttgat

SEQ ID NO: 231668 - DNA, 23 bp, Artificial sequence
  SiRNA target sequence
tccttttacaaaaatatttgatg

SEQ ID NO: 231669 - DNA, 23 bp, Artificial sequence
  SiRNA target sequence
ccttttacaaaaatatttgatgt

SEQ ID NO: 231670 - DNA, 23 bp, Artificial sequence
  SiRNA target sequence
cttttacaaaaatatttgatgta

SEQ ID NO: 231671 - DNA, 23 bp, Artificial sequence
  SiRNA target sequence
ttttacaaaaatatttgatgtaa

SEQ ID NO: 231672 - DNA, 23 bp, Artificial sequence
  SiRNA target sequence
tttacaaaaatatttgatgtaac

SEQ ID NO: 231673 - DNA, 23 bp, Artificial sequence
  SiRNA target sequence
ttacaaaaatatttgatgtaact

SEQ ID NO: 231674 - DNA, 23 bp, Artificial sequence
  SiRNA target sequence
tacaaaaatatttgatgtaactt

SEQ ID NO: 231675 - DNA, 23 bp, Artificial sequence
  SiRNA target sequence
acaaaaatatttgatgtaacttt

SEQ ID NO: 231676 - DNA, 23 bp, Artificial sequence
  SiRNA target sequence
caaaaatatttgatgtaacttta

SEQ ID NO: 231677 - DNA, 23 bp, Artificial sequence
  SiRNA target sequence
aaaaatatttgatgtaactttaa

SEQ ID NO: 231678 - DNA, 23 bp, Artificial sequence
  SiRNA target sequence
aaaatatttgatgtaactttaat

SEQ ID NO: 231679 - DNA, 23 bp, Artificial sequence
  SiRNA target sequence
aaatatttgatgtaactttaata

SEQ ID NO: 231680 - DNA, 23 bp, Artificial sequence
  SiRNA target sequence
aatatttgatgtaactttaatag

SEQ ID NO: 231681 - DNA, 23 bp, Artificial sequence
  SiRNA target sequence
atatttgatgtaactttaatagt

SEQ ID NO: 231682 - DNA, 23 bp, Artificial sequence
  SiRNA target sequence
tatttgatgtaactttaatagtt

SEQ ID NO: 231683 - DNA, 23 bp, Artificial sequence
  SiRNA target sequence
atttgatgtaactttaatagttt

SEQ ID NO: 231684 - DNA, 23 bp, Artificial sequence
  SiRNA target sequence
tttgatgtaactttaatagtttt

SEQ ID NO: 231685 - DNA, 23 bp, Artificial sequence
  SiRNA target sequence
ttgatgtaactttaatagttttc

SEQ ID NO: 231686 - DNA, 23 bp, Artificial sequence
  SiRNA target sequence
tgatgtaactttaatagttttcg

SEQ ID NO: 231687 - DNA, 23 bp, Artificial sequence
  SiRNA target sequence
gatgtaactttaatagttttcgc

SEQ ID NO: 231688 - DNA, 23 bp, Artificial sequence
  SiRNA target sequence
atgtaactttaatagttttcgct

SEQ ID NO: 231689 - DNA, 23 bp, Artificial sequence
  SiRNA target sequence
tgtaactttaatagttttcgctg

SEQ ID NO: 231690 - DNA, 23 bp, Artificial sequence
  SiRNA target sequence
gtaactttaatagttttcgctgt

SEQ ID NO: 231691 - DNA, 23 bp, Artificial sequence
  SiRNA target sequence
taactttaatagttttcgctgtt

SEQ ID NO: 231692 - DNA, 23 bp, Artificial sequence
  SiRNA target sequence
aactttaatagttttcgctgttg

SEQ ID NO: 231693 - DNA, 23 bp, Artificial sequence
  SiRNA target sequence
actttaatagttttcgctgttgc

SEQ ID NO: 231694 - DNA, 23 bp, Artificial sequence
  SiRNA target sequence
ctttaatagttttcgctgttgca

SEQ ID NO: 231695 - DNA, 23 bp, Artificial sequence
  SiRNA target sequence
tttaatagttttcgctgttgcat

SEQ ID NO: 231696 - DNA, 23 bp, Artificial sequence
  SiRNA target sequence
ttaatagttttcgctgttgcatt

SEQ ID NO: 231697 - DNA, 23 bp, Artificial sequence
  SiRNA target sequence
taatagttttcgctgttgcattt

SEQ ID NO: 231698 - DNA, 23 bp, Artificial sequence
  SiRNA target sequence
aatagttttcgctgttgcattta

SEQ ID NO: 231699 - DNA, 23 bp, Artificial sequence
  SiRNA target sequence
atagttttcgctgttgcatttac

SEQ ID NO: 231700 - DNA, 23 bp, Artificial sequence
  SiRNA target sequence
tagttttcgctgttgcatttact

SEQ ID NO: 231701 - DNA, 23 bp, Artificial sequence
  SiRNA target sequence
agttttcgctgttgcatttacta

SEQ ID NO: 231702 - DNA, 23 bp, Artificial sequence
  SiRNA target sequence
gttttcgctgttgcatttactat

SEQ ID NO: 231703 - DNA, 23 bp, Artificial sequence
  SiRNA target sequence
ttttcgctgttgcatttactata

SEQ ID NO: 231704 - DNA, 23 bp, Artificial sequence
  SiRNA target sequence
tttcgctgttgcatttactatac

SEQ ID NO: 231705 - DNA, 23 bp, Artificial sequence
  SiRNA target sequence
ttcgctgttgcatttactatact

SEQ ID NO: 231706 - DNA, 23 bp, Artificial sequence
  SiRNA target sequence
tcgctgttgcatttactatactt

SEQ ID NO: 231707 - DNA, 23 bp, Artificial sequence
  SiRNA target sequence
cgctgttgcatttactatacttg

SEQ ID NO: 231708 - DNA, 23 bp, Artificial sequence
  SiRNA target sequence
gctgttgcatttactatacttgg

SEQ ID NO: 231709 - DNA, 23 bp, Artificial sequence
  SiRNA target sequence
ctgttgcatttactatacttggt

SEQ ID NO: 231710 - DNA, 23 bp, Artificial sequence
  SiRNA target sequence
tgttgcatttactatacttggta

SEQ ID NO: 231711 - DNA, 23 bp, Artificial sequence
  SiRNA target sequence
gttgcatttactatacttggtag

SEQ ID NO: 231712 - DNA, 23 bp, Artificial sequence
  SiRNA target sequence
ttgcatttactatacttggtagt

SEQ ID NO: 231713 - DNA, 23 bp, Artificial sequence
  SiRNA target sequence
tgcatttactatacttggtagtt

SEQ ID NO: 231714 - DNA, 23 bp, Artificial sequence
  SiRNA target sequence
gcatttactatacttggtagttt

SEQ ID NO: 231715 - DNA, 23 bp, Artificial sequence
  SiRNA target sequence
catttactatacttggtagttta

SEQ ID NO: 231716 - DNA, 23 bp, Artificial sequence
  SiRNA target sequence
atttactatacttggtagtttat

SEQ ID NO: 231717 - DNA, 23 bp, Artificial sequence
  SiRNA target sequence
tttactatacttggtagtttatt

SEQ ID NO: 231718 - DNA, 23 bp, Artificial sequence
  SiRNA target sequence
ttactatacttggtagtttatta

SEQ ID NO: 231719 - DNA, 23 bp, Artificial sequence
  SiRNA target sequence
tactatacttggtagtttattac

SEQ ID NO: 231720 - DNA, 23 bp, Artificial sequence
  SiRNA target sequence
actatacttggtagtttattact

SEQ ID NO: 231721 - DNA, 23 bp, Artificial sequence
  SiRNA target sequence
ctatacttggtagtttattactt

SEQ ID NO: 231722 - DNA, 23 bp, Artificial sequence
  SiRNA target sequence
tatacttggtagtttattacttc

SEQ ID NO: 231723 - DNA, 23 bp, Artificial sequence
  SiRNA target sequence
atacttggtagtttattacttcc

SEQ ID NO: 231724 - DNA, 23 bp, Artificial sequence
  SiRNA target sequence
tacttggtagtttattacttccc

SEQ ID NO: 231725 - DNA, 23 bp, Artificial sequence
  SiRNA target sequence
acttggtagtttattacttccct

SEQ ID NO: 231726 - DNA, 23 bp, Artificial sequence
  SiRNA target sequence
cttggtagtttattacttccctt

SEQ ID NO: 231727 - DNA, 23 bp, Artificial sequence
  SiRNA target sequence
ttggtagtttattacttcccttt

SEQ ID NO: 231728 - DNA, 23 bp, Artificial sequence
  SiRNA target sequence
tggtagtttattacttcccttta

SEQ ID NO: 231729 - DNA, 23 bp, Artificial sequence
  SiRNA target sequence
ggtagtttattacttccctttag

SEQ ID NO: 231730 - DNA, 23 bp, Artificial sequence
  SiRNA target sequence
gtagtttattacttccctttagt

SEQ ID NO: 231731 - DNA, 23 bp, Artificial sequence
  SiRNA target sequence
tagtttattacttccctttagtg

SEQ ID NO: 231732 - DNA, 23 bp, Artificial sequence
  SiRNA target sequence
agtttattacttccctttagtga

SEQ ID NO: 231733 - DNA, 23 bp, Artificial sequence
  SiRNA target sequence
gtttattacttccctttagtgat

SEQ ID NO: 231734 - DNA, 23 bp, Artificial sequence
  SiRNA target sequence
tttattacttccctttagtgatt

SEQ ID NO: 231735 - DNA, 23 bp, Artificial sequence
  SiRNA target sequence
ttattacttccctttagtgatta

SEQ ID NO: 231736 - DNA, 23 bp, Artificial sequence
  SiRNA target sequence
tattacttccctttagtgattat

SEQ ID NO: 231737 - DNA, 23 bp, Artificial sequence
  SiRNA target sequence
attacttccctttagtgattata

SEQ ID NO: 231738 - DNA, 23 bp, Artificial sequence
  SiRNA target sequence
ttacttccctttagtgattatat

SEQ ID NO: 231739 - DNA, 23 bp, Artificial sequence
  SiRNA target sequence
tacttccctttagtgattatatt

SEQ ID NO: 231740 - DNA, 23 bp, Artificial sequence
  SiRNA target sequence
acttccctttagtgattatattc

SEQ ID NO: 231741 - DNA, 23 bp, Artificial sequence
  SiRNA target sequence
cttccctttagtgattatattca

SEQ ID NO: 231742 - DNA, 23 bp, Artificial sequence
  SiRNA target sequence
ttccctttagtgattatattcag

SEQ ID NO: 231743 - DNA, 23 bp, Artificial sequence
  SiRNA target sequence
tccctttagtgattatattcaga

SEQ ID NO: 231744 - DNA, 23 bp, Artificial sequence
  SiRNA target sequence
ccctttagtgattatattcagat

SEQ ID NO: 231745 - DNA, 23 bp, Artificial sequence
  SiRNA target sequence
cctttagtgattatattcagatt

SEQ ID NO: 231746 - DNA, 23 bp, Artificial sequence
  SiRNA target sequence
ctttagtgattatattcagattc

SEQ ID NO: 231747 - DNA, 23 bp, Artificial sequence
  SiRNA target sequence
tttagtgattatattcagattca

SEQ ID NO: 231748 - DNA, 23 bp, Artificial sequence
  SiRNA target sequence
ttagtgattatattcagattcaa

SEQ ID NO: 231749 - DNA, 23 bp, Artificial sequence
  SiRNA target sequence
tagtgattatattcagattcaac

SEQ ID NO: 231750 - DNA, 23 bp, Artificial sequence
  SiRNA target sequence
agtgattatattcagattcaacc

SEQ ID NO: 231751 - DNA, 23 bp, Artificial sequence
  SiRNA target sequence
gtgattatattcagattcaaccg

SEQ ID NO: 231752 - DNA, 23 bp, Artificial sequence
  SiRNA target sequence
tgattatattcagattcaaccgt

SEQ ID NO: 231753 - DNA, 23 bp, Artificial sequence
  SiRNA target sequence
gattatattcagattcaaccgtt

SEQ ID NO: 231754 - DNA, 23 bp, Artificial sequence
  SiRNA target sequence
attatattcagattcaaccgttt

SEQ ID NO: 231755 - DNA, 23 bp, Artificial sequence
  SiRNA target sequence
ttatattcagattcaaccgtttt

SEQ ID NO: 231756 - DNA, 23 bp, Artificial sequence
  SiRNA target sequence
tatattcagattcaaccgttttg

SEQ ID NO: 231757 - DNA, 23 bp, Artificial sequence
  SiRNA target sequence
atattcagattcaaccgttttgg

SEQ ID NO: 231758 - DNA, 23 bp, Artificial sequence
  SiRNA target sequence
tattcagattcaaccgttttggg

SEQ ID NO: 231759 - DNA, 23 bp, Artificial sequence
  SiRNA target sequence
attcagattcaaccgttttgggc

SEQ ID NO: 231760 - DNA, 23 bp, Artificial sequence
  SiRNA target sequence
ttcagattcaaccgttttgggcc

SEQ ID NO: 231761 - DNA, 23 bp, Artificial sequence
  SiRNA target sequence
tcagattcaaccgttttgggcca

SEQ ID NO: 231762 - DNA, 23 bp, Artificial sequence
  SiRNA target sequence
cagattcaaccgttttgggccaa

SEQ ID NO: 231763 - DNA, 23 bp, Artificial sequence
  SiRNA target sequence
agattcaaccgttttgggccaaa

SEQ ID NO: 231764 - DNA, 23 bp, Artificial sequence
  SiRNA target sequence
gattcaaccgttttgggccaaag

SEQ ID NO: 231765 - DNA, 23 bp, Artificial sequence
  SiRNA target sequence
attcaaccgttttgggccaaaga

SEQ ID NO: 231766 - DNA, 23 bp, Artificial sequence
  SiRNA target sequence
ttcaaccgttttgggccaaagat

SEQ ID NO: 231767 - DNA, 23 bp, Artificial sequence
  SiRNA target sequence
tcaaccgttttgggccaaagata

SEQ ID NO: 231768 - DNA, 23 bp, Artificial sequence
  SiRNA target sequence
caaccgttttgggccaaagatat

SEQ ID NO: 231769 - DNA, 23 bp, Artificial sequence
  SiRNA target sequence
aaccgttttgggccaaagatatt

SEQ ID NO: 231770 - DNA, 23 bp, Artificial sequence
  SiRNA target sequence
accgttttgggccaaagatattt

SEQ ID NO: 231771 - DNA, 23 bp, Artificial sequence
  SiRNA target sequence
ccgttttgggccaaagatatttt

SEQ ID NO: 231772 - DNA, 23 bp, Artificial sequence
  SiRNA target sequence
cgttttgggccaaagatattttt

SEQ ID NO: 231773 - DNA, 23 bp, Artificial sequence
  SiRNA target sequence
gttttgggccaaagatatttttg

SEQ ID NO: 231774 - DNA, 23 bp, Artificial sequence
  SiRNA target sequence
ttttgggccaaagatatttttgc

SEQ ID NO: 231775 - DNA, 23 bp, Artificial sequence
  SiRNA target sequence
tttgggccaaagatatttttgct

SEQ ID NO: 231776 - DNA, 23 bp, Artificial sequence
  SiRNA target sequence
ttgggccaaagatatttttgctg

SEQ ID NO: 231777 - DNA, 23 bp, Artificial sequence
  SiRNA target sequence
tgggccaaagatatttttgctga

SEQ ID NO: 231778 - DNA, 23 bp, Artificial sequence
  SiRNA target sequence
gggccaaagatatttttgctgat

SEQ ID NO: 231779 - DNA, 23 bp, Artificial sequence
  SiRNA target sequence
ggccaaagatatttttgctgatg

SEQ ID NO: 231780 - DNA, 23 bp, Artificial sequence
  SiRNA target sequence
gccaaagatatttttgctgatgg

SEQ ID NO: 231781 - DNA, 23 bp, Artificial sequence
  SiRNA target sequence
ccaaagatatttttgctgatgga

SEQ ID NO: 231782 - DNA, 23 bp, Artificial sequence
  SiRNA target sequence
caaagatatttttgctgatggaa

SEQ ID NO: 231783 - DNA, 23 bp, Artificial sequence
  SiRNA target sequence
aaagatatttttgctgatggaaa

SEQ ID NO: 231784 - DNA, 23 bp, Artificial sequence
  SiRNA target sequence
aagatatttttgctgatggaaaa

SEQ ID NO: 231785 - DNA, 23 bp, Artificial sequence
  SiRNA target sequence
agatatttttgctgatggaaaag

SEQ ID NO: 231786 - DNA, 23 bp, Artificial sequence
  SiRNA target sequence
gatatttttgctgatggaaaagc

SEQ ID NO: 231787 - DNA, 23 bp, Artificial sequence
  SiRNA target sequence
atatttttgctgatggaaaagct

SEQ ID NO: 231788 - DNA, 23 bp, Artificial sequence
  SiRNA target sequence
tatttttgctgatggaaaagctg

SEQ ID NO: 231789 - DNA, 23 bp, Artificial sequence
  SiRNA target sequence
atttttgctgatggaaaagctgt

SEQ ID NO: 231790 - DNA, 23 bp, Artificial sequence
  SiRNA target sequence
tttttgctgatggaaaagctgtt

SEQ ID NO: 231791 - DNA, 23 bp, Artificial sequence
  SiRNA target sequence
ttttgctgatggaaaagctgttg

SEQ ID NO: 231792 - DNA, 23 bp, Artificial sequence
  SiRNA target sequence
tttgctgatggaaaagctgttgc

SEQ ID NO: 231793 - DNA, 23 bp, Artificial sequence
  SiRNA target sequence
ttgctgatggaaaagctgttgcc

SEQ ID NO: 231794 - DNA, 23 bp, Artificial sequence
  SiRNA target sequence
tgctgatggaaaagctgttgcca

SEQ ID NO: 231795 - DNA, 23 bp, Artificial sequence
  SiRNA target sequence
gctgatggaaaagctgttgccag

SEQ ID NO: 231796 - DNA, 23 bp, Artificial sequence
  SiRNA target sequence
ctgatggaaaagctgttgccaga

SEQ ID NO: 231797 - DNA, 23 bp, Artificial sequence
  SiRNA target sequence
tgatggaaaagctgttgccagaa

SEQ ID NO: 231798 - DNA, 23 bp, Artificial sequence
  SiRNA target sequence
gatggaaaagctgttgccagaag

SEQ ID NO: 231799 - DNA, 23 bp, Artificial sequence
  SiRNA target sequence
atggaaaagctgttgccagaagt

SEQ ID NO: 231800 - DNA, 23 bp, Artificial sequence
  SiRNA target sequence
tggaaaagctgttgccagaagta

SEQ ID NO: 231801 - DNA, 23 bp, Artificial sequence
  SiRNA target sequence
ggaaaagctgttgccagaagtac

SEQ ID NO: 231802 - DNA, 23 bp, Artificial sequence
  SiRNA target sequence
gaaaagctgttgccagaagtaca

SEQ ID NO: 231803 - DNA, 23 bp, Artificial sequence
  SiRNA target sequence
aaaagctgttgccagaagtacag

SEQ ID NO: 231804 - DNA, 23 bp, Artificial sequence
  SiRNA target sequence
aaagctgttgccagaagtacaga

SEQ ID NO: 231805 - DNA, 23 bp, Artificial sequence
  SiRNA target sequence
aagctgttgccagaagtacagat

SEQ ID NO: 231806 - DNA, 23 bp, Artificial sequence
  SiRNA target sequence
agctgttgccagaagtacagatt

SEQ ID NO: 231807 - DNA, 23 bp, Artificial sequence
  SiRNA target sequence
gctgttgccagaagtacagattt

SEQ ID NO: 231808 - DNA, 23 bp, Artificial sequence
  SiRNA target sequence
ctgttgccagaagtacagatttt

SEQ ID NO: 231809 - DNA, 23 bp, Artificial sequence
  SiRNA target sequence
tgttgccagaagtacagattttt

SEQ ID NO: 231810 - DNA, 23 bp, Artificial sequence
  SiRNA target sequence
gttgccagaagtacagatttttt

SEQ ID NO: 231811 - DNA, 23 bp, Artificial sequence
  SiRNA target sequence
ttgccagaagtacagatttttta

SEQ ID NO: 231812 - DNA, 23 bp, Artificial sequence
  SiRNA target sequence
tgccagaagtacagattttttat

SEQ ID NO: 231813 - DNA, 23 bp, Artificial sequence
  SiRNA target sequence
gccagaagtacagattttttatt

SEQ ID NO: 231814 - DNA, 23 bp, Artificial sequence
  SiRNA target sequence
ccagaagtacagattttttattt

SEQ ID NO: 231815 - DNA, 23 bp, Artificial sequence
  SiRNA target sequence
cagaagtacagattttttatttt

SEQ ID NO: 231816 - DNA, 23 bp, Artificial sequence
  SiRNA target sequence
agaagtacagattttttattttc

SEQ ID NO: 231817 - DNA, 23 bp, Artificial sequence
  SiRNA target sequence
gaagtacagattttttattttct

SEQ ID NO: 231818 - DNA, 23 bp, Artificial sequence
  SiRNA target sequence
aagtacagattttttattttcta

SEQ ID NO: 231819 - DNA, 23 bp, Artificial sequence
  SiRNA target sequence
agtacagattttttattttctat

SEQ ID NO: 231820 - DNA, 23 bp, Artificial sequence
  SiRNA target sequence
gtacagattttttattttctatt

SEQ ID NO: 231821 - DNA, 23 bp, Artificial sequence
  SiRNA target sequence
tacagattttttattttctattg

SEQ ID NO: 231822 - DNA, 23 bp, Artificial sequence
  SiRNA target sequence
acagattttttattttctattgc

SEQ ID NO: 231823 - DNA, 23 bp, Artificial sequence
  SiRNA target sequence
cagattttttattttctattgca

SEQ ID NO: 231824 - DNA, 23 bp, Artificial sequence
  SiRNA target sequence
agattttttattttctattgcac

SEQ ID NO: 231825 - DNA, 23 bp, Artificial sequence
  SiRNA target sequence
gattttttattttctattgcact

SEQ ID NO: 231826 - DNA, 23 bp, Artificial sequence
  SiRNA target sequence
attttttattttctattgcactt

SEQ ID NO: 231827 - DNA, 23 bp, Artificial sequence
  SiRNA target sequence
ttttttattttctattgcacttg

SEQ ID NO: 231828 - DNA, 23 bp, Artificial sequence
  SiRNA target sequence
tttttattttctattgcacttgt

SEQ ID NO: 231829 - DNA, 23 bp, Artificial sequence
  SiRNA target sequence
ttttattttctattgcacttgtt

SEQ ID NO: 231830 - DNA, 23 bp, Artificial sequence
  SiRNA target sequence
tttattttctattgcacttgttt

SEQ ID NO: 231831 - DNA, 23 bp, Artificial sequence
  SiRNA target sequence
ttattttctattgcacttgtttt

SEQ ID NO: 231832 - DNA, 23 bp, Artificial sequence
  SiRNA target sequence
tattttctattgcacttgttttc

SEQ ID NO: 231833 - DNA, 23 bp, Artificial sequence
  SiRNA target sequence
attttctattgcacttgttttca

SEQ ID NO: 231834 - DNA, 23 bp, Artificial sequence
  SiRNA target sequence
ttttctattgcacttgttttcaa

SEQ ID NO: 231835 - DNA, 23 bp, Artificial sequence
  SiRNA target sequence
tttctattgcacttgttttcaat

SEQ ID NO: 231836 - DNA, 23 bp, Artificial sequence
  SiRNA target sequence
ttctattgcacttgttttcaatg

SEQ ID NO: 231837 - DNA, 23 bp, Artificial sequence
  SiRNA target sequence
tctattgcacttgttttcaatga

SEQ ID NO: 231838 - DNA, 23 bp, Artificial sequence
  SiRNA target sequence
ctattgcacttgttttcaatgaa

SEQ ID NO: 231839 - DNA, 23 bp, Artificial sequence
  SiRNA target sequence
tattgcacttgttttcaatgaat

SEQ ID NO: 231840 - DNA, 23 bp, Artificial sequence
  SiRNA target sequence
attgcacttgttttcaatgaatg

SEQ ID NO: 231841 - DNA, 23 bp, Artificial sequence
  SiRNA target sequence
ttgcacttgttttcaatgaatgg

SEQ ID NO: 231842 - DNA, 23 bp, Artificial sequence
  SiRNA target sequence
tgcacttgttttcaatgaatgga

SEQ ID NO: 231843 - DNA, 23 bp, Artificial sequence
  SiRNA target sequence
gcacttgttttcaatgaatggac

SEQ ID NO: 231844 - DNA, 23 bp, Artificial sequence
  SiRNA target sequence
cacttgttttcaatgaatggaca

SEQ ID NO: 231845 - DNA, 23 bp, Artificial sequence
  SiRNA target sequence
acttgttttcaatgaatggacaa

SEQ ID NO: 231846 - DNA, 23 bp, Artificial sequence
  SiRNA target sequence
cttgttttcaatgaatggacaag

SEQ ID NO: 231847 - DNA, 23 bp, Artificial sequence
  SiRNA target sequence
ttgttttcaatgaatggacaagt

SEQ ID NO: 231848 - DNA, 23 bp, Artificial sequence
  SiRNA target sequence
tgttttcaatgaatggacaagtt

SEQ ID NO: 231849 - DNA, 23 bp, Artificial sequence
  SiRNA target sequence
gttttcaatgaatggacaagttc

SEQ ID NO: 231850 - DNA, 23 bp, Artificial sequence
  SiRNA target sequence
ttttcaatgaatggacaagttct

SEQ ID NO: 231851 - DNA, 23 bp, Artificial sequence
  SiRNA target sequence
tttcaatgaatggacaagttctg

SEQ ID NO: 231852 - DNA, 23 bp, Artificial sequence
  SiRNA target sequence
ttcaatgaatggacaagttctgc

SEQ ID NO: 231853 - DNA, 23 bp, Artificial sequence
  SiRNA target sequence
tcaatgaatggacaagttctgct

SEQ ID NO: 231854 - DNA, 23 bp, Artificial sequence
  SiRNA target sequence
caatgaatggacaagttctgcta

SEQ ID NO: 231855 - DNA, 23 bp, Artificial sequence
  SiRNA target sequence
aatgaatggacaagttctgctat

SEQ ID NO: 231856 - DNA, 23 bp, Artificial sequence
  SiRNA target sequence
atgaatggacaagttctgctatc

SEQ ID NO: 231857 - DNA, 23 bp, Artificial sequence
  SiRNA target sequence
tgaatggacaagttctgctatct

SEQ ID NO: 231858 - DNA, 23 bp, Artificial sequence
  SiRNA target sequence
gaatggacaagttctgctatcta

SEQ ID NO: 231859 - DNA, 23 bp, Artificial sequence
  SiRNA target sequence
aatggacaagttctgctatctat

SEQ ID NO: 231860 - DNA, 23 bp, Artificial sequence
  SiRNA target sequence
atggacaagttctgctatctatg

SEQ ID NO: 231861 - DNA, 23 bp, Artificial sequence
  SiRNA target sequence
tggacaagttctgctatctatgt

SEQ ID NO: 231862 - DNA, 23 bp, Artificial sequence
  SiRNA target sequence
ggacaagttctgctatctatgtt

SEQ ID NO: 231863 - DNA, 23 bp, Artificial sequence
  SiRNA target sequence
gacaagttctgctatctatgttt

SEQ ID NO: 231864 - DNA, 23 bp, Artificial sequence
  SiRNA target sequence
acaagttctgctatctatgtttt

SEQ ID NO: 231865 - DNA, 23 bp, Artificial sequence
  SiRNA target sequence
caagttctgctatctatgtttta

SEQ ID NO: 231866 - DNA, 23 bp, Artificial sequence
  SiRNA target sequence
aagttctgctatctatgttttat

SEQ ID NO: 231867 - DNA, 23 bp, Artificial sequence
  SiRNA target sequence
agttctgctatctatgttttatc

SEQ ID NO: 231868 - DNA, 23 bp, Artificial sequence
  SiRNA target sequence
gttctgctatctatgttttatct

SEQ ID NO: 231869 - DNA, 23 bp, Artificial sequence
  SiRNA target sequence
ttctgctatctatgttttatctg

SEQ ID NO: 231870 - DNA, 23 bp, Artificial sequence
  SiRNA target sequence
tctgctatctatgttttatctga

SEQ ID NO: 231871 - DNA, 23 bp, Artificial sequence
  SiRNA target sequence
ctgctatctatgttttatctgaa

SEQ ID NO: 231872 - DNA, 23 bp, Artificial sequence
  SiRNA target sequence
tgctatctatgttttatctgaaa

SEQ ID NO: 231873 - DNA, 23 bp, Artificial sequence
  SiRNA target sequence
gctatctatgttttatctgaaat

SEQ ID NO: 231874 - DNA, 23 bp, Artificial sequence
  SiRNA target sequence
ctatctatgttttatctgaaatg

SEQ ID NO: 231875 - DNA, 23 bp, Artificial sequence
  SiRNA target sequence
tatctatgttttatctgaaatgt

SEQ ID NO: 231876 - DNA, 23 bp, Artificial sequence
  SiRNA target sequence
atctatgttttatctgaaatgtt

SEQ ID NO: 231877 - DNA, 23 bp, Artificial sequence
  SiRNA target sequence
tctatgttttatctgaaatgttt

SEQ ID NO: 231878 - DNA, 23 bp, Artificial sequence
  SiRNA target sequence
ctatgttttatctgaaatgtttg

SEQ ID NO: 231879 - DNA, 23 bp, Artificial sequence
  SiRNA target sequence
tatgttttatctgaaatgtttgg

SEQ ID NO: 231880 - DNA, 23 bp, Artificial sequence
  SiRNA target sequence
atgttttatctgaaatgtttggt

SEQ ID NO: 231881 - DNA, 23 bp, Artificial sequence
  SiRNA target sequence
tgttttatctgaaatgtttggta

SEQ ID NO: 231882 - DNA, 23 bp, Artificial sequence
  SiRNA target sequence
gttttatctgaaatgtttggtag

SEQ ID NO: 231883 - DNA, 23 bp, Artificial sequence
  SiRNA target sequence
ttttatctgaaatgtttggtagt

SEQ ID NO: 231884 - DNA, 23 bp, Artificial sequence
  SiRNA target sequence
tttatctgaaatgtttggtagtt

SEQ ID NO: 231885 - DNA, 23 bp, Artificial sequence
  SiRNA target sequence
ttatctgaaatgtttggtagttt

SEQ ID NO: 231886 - DNA, 23 bp, Artificial sequence
  SiRNA target sequence
tatctgaaatgtttggtagtttg

SEQ ID NO: 231887 - DNA, 23 bp, Artificial sequence
  SiRNA target sequence
atctgaaatgtttggtagtttga

SEQ ID NO: 231888 - DNA, 23 bp, Artificial sequence
  SiRNA target sequence
tctgaaatgtttggtagtttgat

SEQ ID NO: 231889 - DNA, 23 bp, Artificial sequence
  SiRNA target sequence
ctgaaatgtttggtagtttgatt

SEQ ID NO: 231890 - DNA, 23 bp, Artificial sequence
  SiRNA target sequence
tgaaatgtttggtagtttgattc

SEQ ID NO: 231891 - DNA, 23 bp, Artificial sequence
  SiRNA target sequence
gaaatgtttggtagtttgattct

SEQ ID NO: 231892 - DNA, 23 bp, Artificial sequence
  SiRNA target sequence
aaatgtttggtagtttgattctt

SEQ ID NO: 231893 - DNA, 23 bp, Artificial sequence
  SiRNA target sequence
aatgtttggtagtttgattcttt

SEQ ID NO: 231894 - DNA, 23 bp, Artificial sequence
  SiRNA target sequence
atgtttggtagtttgattctttc

SEQ ID NO: 231895 - DNA, 23 bp, Artificial sequence
  SiRNA target sequence
tgtttggtagtttgattctttca

SEQ ID NO: 231896 - DNA, 23 bp, Artificial sequence
  SiRNA target sequence
gtttggtagtttgattctttcat

SEQ ID NO: 231897 - DNA, 23 bp, Artificial sequence
  SiRNA target sequence
tttggtagtttgattctttcata

SEQ ID NO: 231898 - DNA, 23 bp, Artificial sequence
  SiRNA target sequence
ttggtagtttgattctttcatat

SEQ ID NO: 231899 - DNA, 23 bp, Artificial sequence
  SiRNA target sequence
tggtagtttgattctttcatatt

SEQ ID NO: 231900 - DNA, 23 bp, Artificial sequence
  SiRNA target sequence
ggtagtttgattctttcatattt

SEQ ID NO: 231901 - DNA, 23 bp, Artificial sequence
  SiRNA target sequence
gtagtttgattctttcatattta

SEQ ID NO: 231902 - DNA, 23 bp, Artificial sequence
  SiRNA target sequence
tagtttgattctttcatatttat

SEQ ID NO: 231903 - DNA, 23 bp, Artificial sequence
  SiRNA target sequence
agtttgattctttcatatttatt

SEQ ID NO: 231904 - DNA, 23 bp, Artificial sequence
  SiRNA target sequence
gtttgattctttcatatttattt

SEQ ID NO: 231905 - DNA, 23 bp, Artificial sequence
  SiRNA target sequence
tttgattctttcatatttattta

SEQ ID NO: 231906 - DNA, 23 bp, Artificial sequence
  SiRNA target sequence
ttgattctttcatatttatttat

SEQ ID NO: 231907 - DNA, 23 bp, Artificial sequence
  SiRNA target sequence
tgattctttcatatttatttatg

SEQ ID NO: 231908 - DNA, 23 bp, Artificial sequence
  SiRNA target sequence
gattctttcatatttatttatga

SEQ ID NO: 231909 - DNA, 23 bp, Artificial sequence
  SiRNA target sequence
attctttcatatttatttatgac

SEQ ID NO: 231910 - DNA, 23 bp, Artificial sequence
  SiRNA target sequence
ttctttcatatttatttatgacg

SEQ ID NO: 231911 - DNA, 23 bp, Artificial sequence
  SiRNA target sequence
tctttcatatttatttatgacgt

SEQ ID NO: 231912 - DNA, 23 bp, Artificial sequence
  SiRNA target sequence
ctttcatatttatttatgacgtt

SEQ ID NO: 231913 - DNA, 23 bp, Artificial sequence
  SiRNA target sequence
tttcatatttatttatgacgttt

SEQ ID NO: 231914 - DNA, 23 bp, Artificial sequence
  SiRNA target sequence
ttcatatttatttatgacgtttg

SEQ ID NO: 231915 - DNA, 23 bp, Artificial sequence
  SiRNA target sequence
tcatatttatttatgacgtttgc

SEQ ID NO: 231916 - DNA, 23 bp, Artificial sequence
  SiRNA target sequence
catatttatttatgacgtttgct

SEQ ID NO: 231917 - DNA, 23 bp, Artificial sequence
  SiRNA target sequence
atatttatttatgacgtttgcta

SEQ ID NO: 231918 - DNA, 23 bp, Artificial sequence
  SiRNA target sequence
tatttatttatgacgtttgctaa

SEQ ID NO: 231919 - DNA, 23 bp, Artificial sequence
  SiRNA target sequence
atttatttatgacgtttgctaat

SEQ ID NO: 231920 - DNA, 23 bp, Artificial sequence
  SiRNA target sequence
tttatttatgacgtttgctaatg

SEQ ID NO: 231921 - DNA, 23 bp, Artificial sequence
  SiRNA target sequence
ttatttatgacgtttgctaatgg

SEQ ID NO: 231922 - DNA, 23 bp, Artificial sequence
  SiRNA target sequence
tatttatgacgtttgctaatggt

SEQ ID NO: 231923 - DNA, 23 bp, Artificial sequence
  SiRNA target sequence
atttatgacgtttgctaatggtc

SEQ ID NO: 231924 - DNA, 23 bp, Artificial sequence
  SiRNA target sequence
tttatgacgtttgctaatggtct

SEQ ID NO: 231925 - DNA, 23 bp, Artificial sequence
  SiRNA target sequence
ttatgacgtttgctaatggtctt

SEQ ID NO: 231926 - DNA, 23 bp, Artificial sequence
  SiRNA target sequence
tatgacgtttgctaatggtcttt

SEQ ID NO: 231927 - DNA, 23 bp, Artificial sequence
  SiRNA target sequence
atgacgtttgctaatggtctttc

SEQ ID NO: 231928 - DNA, 23 bp, Artificial sequence
  SiRNA target sequence
tgacgtttgctaatggtctttcg

SEQ ID NO: 231929 - DNA, 23 bp, Artificial sequence
  SiRNA target sequence
gacgtttgctaatggtctttcga

SEQ ID NO: 231930 - DNA, 23 bp, Artificial sequence
  SiRNA target sequence
acgtttgctaatggtctttcgac

SEQ ID NO: 231931 - DNA, 23 bp, Artificial sequence
  SiRNA target sequence
cgtttgctaatggtctttcgact

SEQ ID NO: 231932 - DNA, 23 bp, Artificial sequence
  SiRNA target sequence
gtttgctaatggtctttcgactc

SEQ ID NO: 231933 - DNA, 23 bp, Artificial sequence
  SiRNA target sequence
tttgctaatggtctttcgactcc

SEQ ID NO: 231934 - DNA, 23 bp, Artificial sequence
  SiRNA target sequence
ttgctaatggtctttcgactcct

SEQ ID NO: 231935 - DNA, 23 bp, Artificial sequence
  SiRNA target sequence
tgctaatggtctttcgactcctg

SEQ ID NO: 231936 - DNA, 23 bp, Artificial sequence
  SiRNA target sequence
gctaatggtctttcgactcctgg

SEQ ID NO: 231937 - DNA, 23 bp, Artificial sequence
  SiRNA target sequence
ctaatggtctttcgactcctgga

SEQ ID NO: 231938 - DNA, 23 bp, Artificial sequence
  SiRNA target sequence
taatggtctttcgactcctggac

SEQ ID NO: 231939 - DNA, 23 bp, Artificial sequence
  SiRNA target sequence
aatggtctttcgactcctggaca

SEQ ID NO: 231940 - DNA, 23 bp, Artificial sequence
  SiRNA target sequence
atggtctttcgactcctggacag

SEQ ID NO: 231941 - DNA, 23 bp, Artificial sequence
  SiRNA target sequence
tggtctttcgactcctggacagt

SEQ ID NO: 231942 - DNA, 23 bp, Artificial sequence
  SiRNA target sequence
ggtctttcgactcctggacagtc

SEQ ID NO: 231943 - DNA, 23 bp, Artificial sequence
  SiRNA target sequence
gtctttcgactcctggacagtcc

SEQ ID NO: 231944 - DNA, 23 bp, Artificial sequence
  SiRNA target sequence
tctttcgactcctggacagtccg

SEQ ID NO: 231945 - DNA, 23 bp, Artificial sequence
  SiRNA target sequence
ctttcgactcctggacagtccgc

SEQ ID NO: 231946 - DNA, 23 bp, Artificial sequence
  SiRNA target sequence
tttcgactcctggacagtccgct

SEQ ID NO: 231947 - DNA, 23 bp, Artificial sequence
  SiRNA target sequence
ttcgactcctggacagtccgcta

SEQ ID NO: 231948 - DNA, 23 bp, Artificial sequence
  SiRNA target sequence
tcgactcctggacagtccgctag

SEQ ID NO: 231949 - DNA, 23 bp, Artificial sequence
  SiRNA target sequence
cgactcctggacagtccgctaga

SEQ ID NO: 231950 - DNA, 23 bp, Artificial sequence
  SiRNA target sequence
gactcctggacagtccgctagat

SEQ ID NO: 231951 - DNA, 23 bp, Artificial sequence
  SiRNA target sequence
actcctggacagtccgctagatt

SEQ ID NO: 231952 - DNA, 23 bp, Artificial sequence
  SiRNA target sequence
ctcctggacagtccgctagattt

SEQ ID NO: 231953 - DNA, 23 bp, Artificial sequence
  SiRNA target sequence
tcctggacagtccgctagatttg

SEQ ID NO: 231954 - DNA, 23 bp, Artificial sequence
  SiRNA target sequence
cctggacagtccgctagatttgt

SEQ ID NO: 231955 - DNA, 23 bp, Artificial sequence
  SiRNA target sequence
ctggacagtccgctagatttgtc

SEQ ID NO: 231956 - DNA, 23 bp, Artificial sequence
  SiRNA target sequence
tggacagtccgctagatttgtcc

SEQ ID NO: 231957 - DNA, 23 bp, Artificial sequence
  SiRNA target sequence
ggacagtccgctagatttgtccc

SEQ ID NO: 231958 - DNA, 23 bp, Artificial sequence
  SiRNA target sequence
gacagtccgctagatttgtccct

SEQ ID NO: 231959 - DNA, 23 bp, Artificial sequence
  SiRNA target sequence
acagtccgctagatttgtccctt

SEQ ID NO: 231960 - DNA, 23 bp, Artificial sequence
  SiRNA target sequence
cagtccgctagatttgtcccttt

SEQ ID NO: 231961 - DNA, 23 bp, Artificial sequence
  SiRNA target sequence
agtccgctagatttgtcccttta

SEQ ID NO: 231962 - DNA, 23 bp, Artificial sequence
  SiRNA target sequence
gtccgctagatttgtccctttat

SEQ ID NO: 231963 - DNA, 23 bp, Artificial sequence
  SiRNA target sequence
tccgctagatttgtccctttatt

SEQ ID NO: 231964 - DNA, 23 bp, Artificial sequence
  SiRNA target sequence
ccgctagatttgtccctttattt

SEQ ID NO: 231965 - DNA, 23 bp, Artificial sequence
  SiRNA target sequence
cgctagatttgtccctttatttt

SEQ ID NO: 231966 - DNA, 23 bp, Artificial sequence
  SiRNA target sequence
gctagatttgtccctttatttta

SEQ ID NO: 231967 - DNA, 23 bp, Artificial sequence
  SiRNA target sequence
ctagatttgtccctttattttat

SEQ ID NO: 231968 - DNA, 23 bp, Artificial sequence
  SiRNA target sequence
tagatttgtccctttattttatg

SEQ ID NO: 231969 - DNA, 23 bp, Artificial sequence
  SiRNA target sequence
agatttgtccctttattttatgt

SEQ ID NO: 231970 - DNA, 23 bp, Artificial sequence
  SiRNA target sequence
gatttgtccctttattttatgtt

SEQ ID NO: 231971 - DNA, 23 bp, Artificial sequence
  SiRNA target sequence
atttgtccctttattttatgttg

SEQ ID NO: 231972 - DNA, 23 bp, Artificial sequence
  SiRNA target sequence
tttgtccctttattttatgttgg

SEQ ID NO: 231973 - DNA, 23 bp, Artificial sequence
  SiRNA target sequence
ttgtccctttattttatgttgga

SEQ ID NO: 231974 - DNA, 23 bp, Artificial sequence
  SiRNA target sequence
tgtccctttattttatgttggat

SEQ ID NO: 231975 - DNA, 23 bp, Artificial sequence
  SiRNA target sequence
gtccctttattttatgttggatc

SEQ ID NO: 231976 - DNA, 23 bp, Artificial sequence
  SiRNA target sequence
tccctttattttatgttggatct

SEQ ID NO: 231977 - DNA, 23 bp, Artificial sequence
  SiRNA target sequence
ccctttattttatgttggatcta

SEQ ID NO: 231978 - DNA, 23 bp, Artificial sequence
  SiRNA target sequence
cctttattttatgttggatctaa

SEQ ID NO: 231979 - DNA, 23 bp, Artificial sequence
  SiRNA target sequence
ctttattttatgttggatctaat

SEQ ID NO: 231980 - DNA, 23 bp, Artificial sequence
  SiRNA target sequence
tttattttatgttggatctaatt

SEQ ID NO: 231981 - DNA, 23 bp, Artificial sequence
  SiRNA target sequence
ttattttatgttggatctaattt

SEQ ID NO: 231982 - DNA, 23 bp, Artificial sequence
  SiRNA target sequence
tattttatgttggatctaatttg

SEQ ID NO: 231983 - DNA, 23 bp, Artificial sequence
  SiRNA target sequence
attttatgttggatctaatttgg

SEQ ID NO: 231984 - DNA, 23 bp, Artificial sequence
  SiRNA target sequence
ttttatgttggatctaatttggc

SEQ ID NO: 231985 - DNA, 23 bp, Artificial sequence
  SiRNA target sequence
tttatgttggatctaatttggct

SEQ ID NO: 231986 - DNA, 23 bp, Artificial sequence
  SiRNA target sequence
ttatgttggatctaatttggctt

SEQ ID NO: 231987 - DNA, 23 bp, Artificial sequence
  SiRNA target sequence
tatgttggatctaatttggcttt

SEQ ID NO: 231988 - DNA, 23 bp, Artificial sequence
  SiRNA target sequence
atgttggatctaatttggcttta

SEQ ID NO: 231989 - DNA, 23 bp, Artificial sequence
  SiRNA target sequence
tgttggatctaatttggctttac

SEQ ID NO: 231990 - DNA, 23 bp, Artificial sequence
  SiRNA target sequence
gttggatctaatttggctttact

SEQ ID NO: 231991 - DNA, 23 bp, Artificial sequence
  SiRNA target sequence
ttggatctaatttggctttactt

SEQ ID NO: 231992 - DNA, 23 bp, Artificial sequence
  SiRNA target sequence
tggatctaatttggctttacttc

SEQ ID NO: 231993 - DNA, 23 bp, Artificial sequence
  SiRNA target sequence
ggatctaatttggctttacttct

SEQ ID NO: 231994 - DNA, 23 bp, Artificial sequence
  SiRNA target sequence
gatctaatttggctttacttctt

SEQ ID NO: 231995 - DNA, 23 bp, Artificial sequence
  SiRNA target sequence
atctaatttggctttacttcttt

SEQ ID NO: 231996 - DNA, 23 bp, Artificial sequence
  SiRNA target sequence
tctaatttggctttacttctttc

SEQ ID NO: 231997 - DNA, 23 bp, Artificial sequence
  SiRNA target sequence
ctaatttggctttacttctttca

SEQ ID NO: 231998 - DNA, 23 bp, Artificial sequence
  SiRNA target sequence
taatttggctttacttctttcag

SEQ ID NO: 231999 - DNA, 23 bp, Artificial sequence
  SiRNA target sequence
aatttggctttacttctttcagg

SEQ ID NO: 232000 - DNA, 23 bp, Artificial sequence
  SiRNA target sequence
atttggctttacttctttcagga

SEQ ID NO: 232001 - DNA, 23 bp, Artificial sequence
  SiRNA target sequence
tttggctttacttctttcaggaa

SEQ ID NO: 232002 - DNA, 23 bp, Artificial sequence
  SiRNA target sequence
ttggctttacttctttcaggaat

SEQ ID NO: 232003 - DNA, 23 bp, Artificial sequence
  SiRNA target sequence
tggctttacttctttcaggaatg

SEQ ID NO: 232004 - DNA, 23 bp, Artificial sequence
  SiRNA target sequence
ggctttacttctttcaggaatga

SEQ ID NO: 232005 - DNA, 23 bp, Artificial sequence
  SiRNA target sequence
gctttacttctttcaggaatgat

SEQ ID NO: 232006 - DNA, 23 bp, Artificial sequence
  SiRNA target sequence
ctttacttctttcaggaatgata

SEQ ID NO: 232007 - DNA, 23 bp, Artificial sequence
  SiRNA target sequence
tttacttctttcaggaatgataa

SEQ ID NO: 232008 - DNA, 23 bp, Artificial sequence
  SiRNA target sequence
ttacttctttcaggaatgataaa

SEQ ID NO: 232009 - DNA, 23 bp, Artificial sequence
  SiRNA target sequence
tacttctttcaggaatgataaat

SEQ ID NO: 232010 - DNA, 23 bp, Artificial sequence
  SiRNA target sequence
acttctttcaggaatgataaatt

SEQ ID NO: 232011 - DNA, 23 bp, Artificial sequence
  SiRNA target sequence
cttctttcaggaatgataaatta

SEQ ID NO: 232012 - DNA, 23 bp, Artificial sequence
  SiRNA target sequence
ttctttcaggaatgataaattac

SEQ ID NO: 232013 - DNA, 23 bp, Artificial sequence
  SiRNA target sequence
tctttcaggaatgataaattact

SEQ ID NO: 232014 - DNA, 23 bp, Artificial sequence
  SiRNA target sequence
ctttcaggaatgataaattactt

SEQ ID NO: 232015 - DNA, 23 bp, Artificial sequence
  SiRNA target sequence
tttcaggaatgataaattacttt

SEQ ID NO: 232016 - DNA, 23 bp, Artificial sequence
  SiRNA target sequence
ttcaggaatgataaattactttt

SEQ ID NO: 232017 - DNA, 23 bp, Artificial sequence
  SiRNA target sequence
tcaggaatgataaattactttta

SEQ ID NO: 232018 - DNA, 23 bp, Artificial sequence
  SiRNA target sequence
caggaatgataaattacttttat

SEQ ID NO: 232019 - DNA, 23 bp, Artificial sequence
  SiRNA target sequence
aggaatgataaattacttttata

SEQ ID NO: 232020 - DNA, 23 bp, Artificial sequence
  SiRNA target sequence
ggaatgataaattacttttatag

SEQ ID NO: 232021 - DNA, 23 bp, Artificial sequence
  SiRNA target sequence
gaatgataaattacttttatagt

SEQ ID NO: 232022 - DNA, 23 bp, Artificial sequence
  SiRNA target sequence
aatgataaattacttttatagtg

SEQ ID NO: 232023 - DNA, 23 bp, Artificial sequence
  SiRNA target sequence
atgataaattacttttatagtgt

SEQ ID NO: 232024 - DNA, 23 bp, Artificial sequence
  SiRNA target sequence
tgataaattacttttatagtgta

SEQ ID NO: 232025 - DNA, 23 bp, Artificial sequence
  SiRNA target sequence
gataaattacttttatagtgtaa

SEQ ID NO: 232026 - DNA, 23 bp, Artificial sequence
  SiRNA target sequence
ataaattacttttatagtgtaag

SEQ ID NO: 232027 - DNA, 23 bp, Artificial sequence
  SiRNA target sequence
taaattacttttatagtgtaagt

SEQ ID NO: 232028 - DNA, 23 bp, Artificial sequence
  SiRNA target sequence
aaattacttttatagtgtaagta

SEQ ID NO: 232029 - DNA, 23 bp, Artificial sequence
  SiRNA target sequence
aattacttttatagtgtaagtaa

SEQ ID NO: 232030 - DNA, 23 bp, Artificial sequence
  SiRNA target sequence
attacttttatagtgtaagtaaa

SEQ ID NO: 232031 - DNA, 23 bp, Artificial sequence
  SiRNA target sequence
ttacttttatagtgtaagtaaat

SEQ ID NO: 232032 - DNA, 23 bp, Artificial sequence
  SiRNA target sequence
tacttttatagtgtaagtaaatc

SEQ ID NO: 232033 - DNA, 23 bp, Artificial sequence
  SiRNA target sequence
acttttatagtgtaagtaaatct

SEQ ID NO: 232034 - DNA, 23 bp, Artificial sequence
  SiRNA target sequence
cttttatagtgtaagtaaatcta

SEQ ID NO: 232035 - DNA, 23 bp, Artificial sequence
  SiRNA target sequence
ttttatagtgtaagtaaatctaa

SEQ ID NO: 232036 - DNA, 23 bp, Artificial sequence
  SiRNA target sequence
tttatagtgtaagtaaatctaaa

SEQ ID NO: 232037 - DNA, 23 bp, Artificial sequence
  SiRNA target sequence
ttatagtgtaagtaaatctaaaa

SEQ ID NO: 232038 - DNA, 23 bp, Artificial sequence
  SiRNA target sequence
tatagtgtaagtaaatctaaaat

SEQ ID NO: 232039 - DNA, 23 bp, Artificial sequence
  SiRNA target sequence
atagtgtaagtaaatctaaaatg

SEQ ID NO: 232040 - DNA, 23 bp, Artificial sequence
  SiRNA target sequence
tagtgtaagtaaatctaaaatgt

SEQ ID NO: 232041 - DNA, 23 bp, Artificial sequence
  SiRNA target sequence
agtgtaagtaaatctaaaatgtc

SEQ ID NO: 232042 - DNA, 23 bp, Artificial sequence
  SiRNA target sequence
gtgtaagtaaatctaaaatgtcg

SEQ ID NO: 232043 - DNA, 23 bp, Artificial sequence
  SiRNA target sequence
tgtaagtaaatctaaaatgtcgt

SEQ ID NO: 232044 - DNA, 23 bp, Artificial sequence
  SiRNA target sequence
gtaagtaaatctaaaatgtcgta

SEQ ID NO: 232045 - DNA, 23 bp, Artificial sequence
  SiRNA target sequence
taagtaaatctaaaatgtcgtat

SEQ ID NO: 232046 - DNA, 23 bp, Artificial sequence
  SiRNA target sequence
aagtaaatctaaaatgtcgtatg

SEQ ID NO: 232047 - DNA, 23 bp, Artificial sequence
  SiRNA target sequence
agtaaatctaaaatgtcgtatgt

SEQ ID NO: 232048 - DNA, 23 bp, Artificial sequence
  SiRNA target sequence
gtaaatctaaaatgtcgtatgtt

SEQ ID NO: 232049 - DNA, 23 bp, Artificial sequence
  SiRNA target sequence
taaatctaaaatgtcgtatgttg

SEQ ID NO: 232050 - DNA, 23 bp, Artificial sequence
  SiRNA target sequence
aaatctaaaatgtcgtatgttgc

SEQ ID NO: 232051 - DNA, 23 bp, Artificial sequence
  SiRNA target sequence
aatctaaaatgtcgtatgttgcg

SEQ ID NO: 232052 - DNA, 23 bp, Artificial sequence
  SiRNA target sequence
atctaaaatgtcgtatgttgcgg

SEQ ID NO: 232053 - DNA, 23 bp, Artificial sequence
  SiRNA target sequence
tctaaaatgtcgtatgttgcggc

SEQ ID NO: 232054 - DNA, 23 bp, Artificial sequence
  SiRNA target sequence
ctaaaatgtcgtatgttgcggcc

SEQ ID NO: 232055 - DNA, 23 bp, Artificial sequence
  SiRNA target sequence
taaaatgtcgtatgttgcggccg

SEQ ID NO: 232056 - DNA, 23 bp, Artificial sequence
  SiRNA target sequence
aaaatgtcgtatgttgcggccga

SEQ ID NO: 232057 - DNA, 23 bp, Artificial sequence
  SiRNA target sequence
aaatgtcgtatgttgcggccgaa

SEQ ID NO: 232058 - DNA, 23 bp, Artificial sequence
  SiRNA target sequence
aatgtcgtatgttgcggccgaaa

SEQ ID NO: 232059 - DNA, 23 bp, Artificial sequence
  SiRNA target sequence
atgtcgtatgttgcggccgaaag

SEQ ID NO: 232060 - DNA, 23 bp, Artificial sequence
  SiRNA target sequence
tgtcgtatgttgcggccgaaaga

SEQ ID NO: 232061 - DNA, 23 bp, Artificial sequence
  SiRNA target sequence
gtcgtatgttgcggccgaaagat

SEQ ID NO: 232062 - DNA, 23 bp, Artificial sequence
  SiRNA target sequence
tcgtatgttgcggccgaaagatt

SEQ ID NO: 232063 - DNA, 23 bp, Artificial sequence
  SiRNA target sequence
cgtatgttgcggccgaaagattt

SEQ ID NO: 232064 - DNA, 23 bp, Artificial sequence
  SiRNA target sequence
gtatgttgcggccgaaagatttt

SEQ ID NO: 232065 - DNA, 23 bp, Artificial sequence
  SiRNA target sequence
tatgttgcggccgaaagattttt

SEQ ID NO: 232066 - DNA, 23 bp, Artificial sequence
  SiRNA target sequence
atgttgcggccgaaagatttttt

SEQ ID NO: 232067 - DNA, 23 bp, Artificial sequence
  SiRNA target sequence
tgttgcggccgaaagatttttta

SEQ ID NO: 232068 - DNA, 23 bp, Artificial sequence
  SiRNA target sequence
gttgcggccgaaagattttttaa

SEQ ID NO: 232069 - DNA, 23 bp, Artificial sequence
  SiRNA target sequence
ttgcggccgaaagattttttaat

SEQ ID NO: 232070 - DNA, 23 bp, Artificial sequence
  SiRNA target sequence
tgcggccgaaagattttttaatg

SEQ ID NO: 232071 - DNA, 23 bp, Artificial sequence
  SiRNA target sequence
gcggccgaaagattttttaatgg

SEQ ID NO: 232072 - DNA, 23 bp, Artificial sequence
  SiRNA target sequence
cggccgaaagattttttaatgga

SEQ ID NO: 232073 - DNA, 23 bp, Artificial sequence
  SiRNA target sequence
ggccgaaagattttttaatggat

SEQ ID NO: 232074 - DNA, 23 bp, Artificial sequence
  SiRNA target sequence
gccgaaagattttttaatggatt

SEQ ID NO: 232075 - DNA, 23 bp, Artificial sequence
  SiRNA target sequence
ccgaaagattttttaatggattt

SEQ ID NO: 232076 - DNA, 23 bp, Artificial sequence
  SiRNA target sequence
cgaaagattttttaatggatttt

SEQ ID NO: 232077 - DNA, 23 bp, Artificial sequence
  SiRNA target sequence
gaaagattttttaatggattttt

SEQ ID NO: 232078 - DNA, 23 bp, Artificial sequence
  SiRNA target sequence
aaagattttttaatggatttttt

SEQ ID NO: 232079 - DNA, 23 bp, Artificial sequence
  SiRNA target sequence
aagattttttaatggattttttt

SEQ ID NO: 232080 - DNA, 23 bp, Artificial sequence
  SiRNA target sequence
agattttttaatggatttttttg

SEQ ID NO: 232081 - DNA, 23 bp, Artificial sequence
  SiRNA target sequence
gattttttaatggatttttttgt

SEQ ID NO: 232082 - DNA, 23 bp, Artificial sequence
  SiRNA target sequence
attttttaatggatttttttgtc

SEQ ID NO: 232083 - DNA, 23 bp, Artificial sequence
  SiRNA target sequence
ttttttaatggatttttttgtct

SEQ ID NO: 232084 - DNA, 23 bp, Artificial sequence
  SiRNA target sequence
tttttaatggatttttttgtctg

SEQ ID NO: 232085 - DNA, 23 bp, Artificial sequence
  SiRNA target sequence
ttttaatggatttttttgtctga

SEQ ID NO: 232086 - DNA, 23 bp, Artificial sequence
  SiRNA target sequence
tttaatggatttttttgtctgag

SEQ ID NO: 232087 - DNA, 23 bp, Artificial sequence
  SiRNA target sequence
ttaatggatttttttgtctgagt

SEQ ID NO: 232088 - DNA, 23 bp, Artificial sequence
  SiRNA target sequence
taatggatttttttgtctgagtg

SEQ ID NO: 232089 - DNA, 23 bp, Artificial sequence
  SiRNA target sequence
aatggatttttttgtctgagtgg

SEQ ID NO: 232090 - DNA, 23 bp, Artificial sequence
  SiRNA target sequence
atggatttttttgtctgagtgga

SEQ ID NO: 232091 - DNA, 23 bp, Artificial sequence
  SiRNA target sequence
tggatttttttgtctgagtggaa

SEQ ID NO: 232092 - DNA, 23 bp, Artificial sequence
  SiRNA target sequence
ggatttttttgtctgagtggaat

SEQ ID NO: 232093 - DNA, 23 bp, Artificial sequence
  SiRNA target sequence
gatttttttgtctgagtggaatt

SEQ ID NO: 232094 - DNA, 23 bp, Artificial sequence
  SiRNA target sequence
atttttttgtctgagtggaattc

SEQ ID NO: 232095 - DNA, 23 bp, Artificial sequence
  SiRNA target sequence
tttttttgtctgagtggaattct

SEQ ID NO: 232096 - DNA, 23 bp, Artificial sequence
  SiRNA target sequence
ttttttgtctgagtggaattctc

SEQ ID NO: 232097 - DNA, 23 bp, Artificial sequence
  SiRNA target sequence
tttttgtctgagtggaattctct

SEQ ID NO: 232098 - DNA, 23 bp, Artificial sequence
  SiRNA target sequence
ttttgtctgagtggaattctctg

SEQ ID NO: 232099 - DNA, 23 bp, Artificial sequence
  SiRNA target sequence
tttgtctgagtggaattctctgt

SEQ ID NO: 232100 - DNA, 23 bp, Artificial sequence
  SiRNA target sequence
ttgtctgagtggaattctctgtg

SEQ ID NO: 232101 - DNA, 23 bp, Artificial sequence
  SiRNA target sequence
tgtctgagtggaattctctgtgc

SEQ ID NO: 232102 - DNA, 23 bp, Artificial sequence
  SiRNA target sequence
gtctgagtggaattctctgtgct

SEQ ID NO: 232103 - DNA, 23 bp, Artificial sequence
  SiRNA target sequence
tctgagtggaattctctgtgctg

SEQ ID NO: 232104 - DNA, 23 bp, Artificial sequence
  SiRNA target sequence
ctgagtggaattctctgtgctgt

SEQ ID NO: 232105 - DNA, 23 bp, Artificial sequence
  SiRNA target sequence
tgagtggaattctctgtgctgta

SEQ ID NO: 232106 - DNA, 23 bp, Artificial sequence
  SiRNA target sequence
gagtggaattctctgtgctgtaa

SEQ ID NO: 232107 - DNA, 23 bp, Artificial sequence
  SiRNA target sequence
agtggaattctctgtgctgtaat

SEQ ID NO: 232108 - DNA, 23 bp, Artificial sequence
  SiRNA target sequence
gtggaattctctgtgctgtaatt

SEQ ID NO: 232109 - DNA, 23 bp, Artificial sequence
  SiRNA target sequence
tggaattctctgtgctgtaattt

SEQ ID NO: 232110 - DNA, 23 bp, Artificial sequence
  SiRNA target sequence
ggaattctctgtgctgtaattta

SEQ ID NO: 232111 - DNA, 23 bp, Artificial sequence
  SiRNA target sequence
gaattctctgtgctgtaatttat

SEQ ID NO: 232112 - DNA, 23 bp, Artificial sequence
  SiRNA target sequence
aattctctgtgctgtaatttatc

SEQ ID NO: 232113 - DNA, 23 bp, Artificial sequence
  SiRNA target sequence
attctctgtgctgtaatttatct

SEQ ID NO: 232114 - DNA, 23 bp, Artificial sequence
  SiRNA target sequence
ttctctgtgctgtaatttatctt

SEQ ID NO: 232115 - DNA, 23 bp, Artificial sequence
  SiRNA target sequence
tctctgtgctgtaatttatcttc

SEQ ID NO: 232116 - DNA, 23 bp, Artificial sequence
  SiRNA target sequence
ctctgtgctgtaatttatcttct

SEQ ID NO: 232117 - DNA, 23 bp, Artificial sequence
  SiRNA target sequence
tctgtgctgtaatttatcttcta

SEQ ID NO: 232118 - DNA, 23 bp, Artificial sequence
  SiRNA target sequence
ctgtgctgtaatttatcttctaa

SEQ ID NO: 232119 - DNA, 23 bp, Artificial sequence
  SiRNA target sequence
tgtgctgtaatttatcttctaaa

SEQ ID NO: 232120 - DNA, 23 bp, Artificial sequence
  SiRNA target sequence
gtgctgtaatttatcttctaaaa

SEQ ID NO: 232121 - DNA, 23 bp, Artificial sequence
  SiRNA target sequence
tgctgtaatttatcttctaaaaa

SEQ ID NO: 232122 - DNA, 23 bp, Artificial sequence
  SiRNA target sequence
gctgtaatttatcttctaaaaaa

SEQ ID NO: 232123 - DNA, 23 bp, Artificial sequence
  SiRNA target sequence
ctgtaatttatcttctaaaaaaa

SEQ ID NO: 232124 - DNA, 23 bp, Artificial sequence
  SiRNA target sequence
tgtaatttatcttctaaaaaaat

SEQ ID NO: 232125 - DNA, 23 bp, Artificial sequence
  SiRNA target sequence
gtaatttatcttctaaaaaaata

SEQ ID NO: 232126 - DNA, 23 bp, Artificial sequence
  SiRNA target sequence
taatttatcttctaaaaaaatat

SEQ ID NO: 232127 - DNA, 23 bp, Artificial sequence
  SiRNA target sequence
aatttatcttctaaaaaaatatt

SEQ ID NO: 232128 - DNA, 23 bp, Artificial sequence
  SiRNA target sequence
atttatcttctaaaaaaatattt

SEQ ID NO: 232129 - DNA, 23 bp, Artificial sequence
  SiRNA target sequence
tttatcttctaaaaaaatattta

SEQ ID NO: 232130 - DNA, 23 bp, Artificial sequence
  SiRNA target sequence
ttatcttctaaaaaaatatttag

SEQ ID NO: 232131 - DNA, 23 bp, Artificial sequence
  SiRNA target sequence
tatcttctaaaaaaatatttaga

SEQ ID NO: 232132 - DNA, 23 bp, Artificial sequence
  SiRNA target sequence
atcttctaaaaaaatatttagaa

SEQ ID NO: 232133 - DNA, 23 bp, Artificial sequence
  SiRNA target sequence
tcttctaaaaaaatatttagaaa

SEQ ID NO: 232134 - DNA, 23 bp, Artificial sequence
  SiRNA target sequence
cttctaaaaaaatatttagaaaa

SEQ ID NO: 232135 - DNA, 23 bp, Artificial sequence
  SiRNA target sequence
ttctaaaaaaatatttagaaaat

SEQ ID NO: 232136 - DNA, 23 bp, Artificial sequence
  SiRNA target sequence
tctaaaaaaatatttagaaaata

SEQ ID NO: 232137 - DNA, 23 bp, Artificial sequence
  SiRNA target sequence
ctaaaaaaatatttagaaaataa

SEQ ID NO: 232138 - DNA, 23 bp, Artificial sequence
  SiRNA target sequence
taaaaaaatatttagaaaataat

SEQ ID NO: 232139 - DNA, 23 bp, Artificial sequence
  SiRNA target sequence
aaaaaaatatttagaaaataatg

SEQ ID NO: 232140 - DNA, 23 bp, Artificial sequence
  SiRNA target sequence
aaaaaatatttagaaaataatgt

SEQ ID NO: 232141 - DNA, 23 bp, Artificial sequence
  SiRNA target sequence
aaaaatatttagaaaataatgtt

SEQ ID NO: 232142 - DNA, 23 bp, Artificial sequence
  SiRNA target sequence
aaaatatttagaaaataatgtta

SEQ ID NO: 232143 - DNA, 23 bp, Artificial sequence
  SiRNA target sequence
aaatatttagaaaataatgttac

SEQ ID NO: 232144 - DNA, 23 bp, Artificial sequence
  SiRNA target sequence
aatatttagaaaataatgttact

SEQ ID NO: 232145 - DNA, 23 bp, Artificial sequence
  SiRNA target sequence
atatttagaaaataatgttacta

SEQ ID NO: 232146 - DNA, 23 bp, Artificial sequence
  SiRNA target sequence
tatttagaaaataatgttactag

SEQ ID NO: 232147 - DNA, 23 bp, Artificial sequence
  SiRNA target sequence
atttagaaaataatgttactagc

SEQ ID NO: 232148 - DNA, 23 bp, Artificial sequence
  SiRNA target sequence
tttagaaaataatgttactagca

SEQ ID NO: 232149 - DNA, 23 bp, Artificial sequence
  SiRNA target sequence
ttagaaaataatgttactagcaa

SEQ ID NO: 232150 - DNA, 23 bp, Artificial sequence
  SiRNA target sequence
tagaaaataatgttactagcaaa

SEQ ID NO: 232151 - DNA, 23 bp, Artificial sequence
  SiRNA target sequence
agaaaataatgttactagcaaac

SEQ ID NO: 232152 - DNA, 23 bp, Artificial sequence
  SiRNA target sequence
gaaaataatgttactagcaaacc

SEQ ID NO: 232153 - DNA, 23 bp, Artificial sequence
  SiRNA target sequence
aaaataatgttactagcaaacca

SEQ ID NO: 232154 - DNA, 23 bp, Artificial sequence
  SiRNA target sequence
aaataatgttactagcaaaccaa

SEQ ID NO: 232155 - DNA, 23 bp, Artificial sequence
  SiRNA target sequence
aataatgttactagcaaaccaat

SEQ ID NO: 232156 - DNA, 23 bp, Artificial sequence
  SiRNA target sequence
ataatgttactagcaaaccaatg

SEQ ID NO: 232157 - DNA, 23 bp, Artificial sequence
  SiRNA target sequence
taatgttactagcaaaccaatgt

SEQ ID NO: 232158 - DNA, 23 bp, Artificial sequence
  SiRNA target sequence
aatgttactagcaaaccaatgtt

SEQ ID NO: 232159 - DNA, 23 bp, Artificial sequence
  SiRNA target sequence
atgttactagcaaaccaatgttt

SEQ ID NO: 232160 - DNA, 23 bp, Artificial sequence
  SiRNA target sequence
tgttactagcaaaccaatgtttg

SEQ ID NO: 232161 - DNA, 23 bp, Artificial sequence
  SiRNA target sequence
gttactagcaaaccaatgtttgt

SEQ ID NO: 232162 - DNA, 23 bp, Artificial sequence
  SiRNA target sequence
ttactagcaaaccaatgtttgtt

SEQ ID NO: 232163 - DNA, 23 bp, Artificial sequence
  SiRNA target sequence
tactagcaaaccaatgtttgtta

SEQ ID NO: 232164 - DNA, 23 bp, Artificial sequence
  SiRNA target sequence
actagcaaaccaatgtttgttag

SEQ ID NO: 232165 - DNA, 23 bp, Artificial sequence
  SiRNA target sequence
ctagcaaaccaatgtttgttaga

SEQ ID NO: 232166 - DNA, 23 bp, Artificial sequence
  SiRNA target sequence
tagcaaaccaatgtttgttagaa

SEQ ID NO: 232167 - DNA, 23 bp, Artificial sequence
  SiRNA target sequence
agcaaaccaatgtttgttagaaa

SEQ ID NO: 232168 - DNA, 23 bp, Artificial sequence
  SiRNA target sequence
gcaaaccaatgtttgttagaaag

SEQ ID NO: 232169 - DNA, 23 bp, Artificial sequence
  SiRNA target sequence
caaaccaatgtttgttagaaaga

SEQ ID NO: 232170 - DNA, 23 bp, Artificial sequence
  SiRNA target sequence
aaaccaatgtttgttagaaagac

SEQ ID NO: 232171 - DNA, 23 bp, Artificial sequence
  SiRNA target sequence
aaccaatgtttgttagaaagact

SEQ ID NO: 232172 - DNA, 23 bp, Artificial sequence
  SiRNA target sequence
accaatgtttgttagaaagactt

SEQ ID NO: 232173 - DNA, 23 bp, Artificial sequence
  SiRNA target sequence
ccaatgtttgttagaaagacttt

SEQ ID NO: 232174 - DNA, 23 bp, Artificial sequence
  SiRNA target sequence
caatgtttgttagaaagactttt

SEQ ID NO: 232175 - DNA, 23 bp, Artificial sequence
  SiRNA target sequence
aatgtttgttagaaagactttta

SEQ ID NO: 232176 - DNA, 23 bp, Artificial sequence
  SiRNA target sequence
atgtttgttagaaagacttttac

SEQ ID NO: 232177 - DNA, 23 bp, Artificial sequence
  SiRNA target sequence
tgtttgttagaaagacttttact

SEQ ID NO: 232178 - DNA, 23 bp, Artificial sequence
  SiRNA target sequence
gtttgttagaaagacttttacta

SEQ ID NO: 232179 - DNA, 23 bp, Artificial sequence
  SiRNA target sequence
tttgttagaaagacttttactaa

SEQ ID NO: 232180 - DNA, 23 bp, Artificial sequence
  SiRNA target sequence
ttgttagaaagacttttactaaa

SEQ ID NO: 232181 - DNA, 23 bp, Artificial sequence
  SiRNA target sequence
tgttagaaagacttttactaaaa

SEQ ID NO: 232182 - DNA, 23 bp, Artificial sequence
  SiRNA target sequence
gttagaaagacttttactaaaaa

SEQ ID NO: 232183 - DNA, 23 bp, Artificial sequence
  SiRNA target sequence
ttagaaagacttttactaaaaag

SEQ ID NO: 232184 - DNA, 23 bp, Artificial sequence
  SiRNA target sequence
tagaaagacttttactaaaaaga

SEQ ID NO: 232185 - DNA, 23 bp, Artificial sequence
  SiRNA target sequence
agaaagacttttactaaaaagaa

SEQ ID NO: 232186 - DNA, 23 bp, Artificial sequence
  SiRNA target sequence
gaaagacttttactaaaaagaag

SEQ ID NO: 232187 - DNA, 23 bp, Artificial sequence
  SiRNA target sequence
aaagacttttactaaaaagaaga

SEQ ID NO: 232188 - DNA, 23 bp, Artificial sequence
  SiRNA target sequence
aagacttttactaaaaagaagag

SEQ ID NO: 232189 - DNA, 23 bp, Artificial sequence
  SiRNA target sequence
agacttttactaaaaagaagagt

SEQ ID NO: 232190 - DNA, 23 bp, Artificial sequence
  SiRNA target sequence
gacttttactaaaaagaagagta

SEQ ID NO: 232191 - DNA, 23 bp, Artificial sequence
  SiRNA target sequence
acttttactaaaaagaagagtaa

SEQ ID NO: 232192 - DNA, 23 bp, Artificial sequence
  SiRNA target sequence
cttttactaaaaagaagagtaaa

SEQ ID NO: 232193 - DNA, 23 bp, Artificial sequence
  SiRNA target sequence
ttttactaaaaagaagagtaaag

SEQ ID NO: 232194 - DNA, 23 bp, Artificial sequence
  SiRNA target sequence
tttactaaaaagaagagtaaagt

SEQ ID NO: 232195 - DNA, 23 bp, Artificial sequence
  SiRNA target sequence
ttactaaaaagaagagtaaagtg

SEQ ID NO: 232196 - DNA, 23 bp, Artificial sequence
  SiRNA target sequence
tactaaaaagaagagtaaagtga

SEQ ID NO: 232197 - DNA, 23 bp, Artificial sequence
  SiRNA target sequence
actaaaaagaagagtaaagtgaa

SEQ ID NO: 232198 - DNA, 23 bp, Artificial sequence
  SiRNA target sequence
ctaaaaagaagagtaaagtgaag

SEQ ID NO: 232199 - DNA, 23 bp, Artificial sequence
  SiRNA target sequence
taaaaagaagagtaaagtgaagg

SEQ ID NO: 232200 - DNA, 23 bp, Artificial sequence
  SiRNA target sequence
aaaaagaagagtaaagtgaaggt

SEQ ID NO: 232201 - DNA, 23 bp, Artificial sequence
  SiRNA target sequence
aaaagaagagtaaagtgaaggtt

SEQ ID NO: 232202 - DNA, 23 bp, Artificial sequence
  SiRNA target sequence
aaagaagagtaaagtgaaggttg

SEQ ID NO: 232203 - DNA, 23 bp, Artificial sequence
  SiRNA target sequence
aagaagagtaaagtgaaggttgg

SEQ ID NO: 232204 - DNA, 23 bp, Artificial sequence
  SiRNA target sequence
agaagagtaaagtgaaggttgga

SEQ ID NO: 232205 - DNA, 23 bp, Artificial sequence
  SiRNA target sequence
gaagagtaaagtgaaggttggat

SEQ ID NO: 232206 - DNA, 23 bp, Artificial sequence
  SiRNA target sequence
aagagtaaagtgaaggttggatt

SEQ ID NO: 232207 - DNA, 23 bp, Artificial sequence
  SiRNA target sequence
agagtaaagtgaaggttggattt

SEQ ID NO: 232208 - DNA, 23 bp, Artificial sequence
  SiRNA target sequence
gagtaaagtgaaggttggatttg

SEQ ID NO: 232209 - DNA, 23 bp, Artificial sequence
  SiRNA target sequence
agtaaagtgaaggttggatttgt

SEQ ID NO: 232210 - DNA, 23 bp, Artificial sequence
  SiRNA target sequence
gtaaagtgaaggttggatttgtt

SEQ ID NO: 232211 - DNA, 23 bp, Artificial sequence
  SiRNA target sequence
taaagtgaaggttggatttgttg

SEQ ID NO: 232212 - DNA, 23 bp, Artificial sequence
  SiRNA target sequence
aaagtgaaggttggatttgttga

SEQ ID NO: 232213 - DNA, 23 bp, Artificial sequence
  SiRNA target sequence
aagtgaaggttggatttgttgat

SEQ ID NO: 232214 - DNA, 23 bp, Artificial sequence
  SiRNA target sequence
agtgaaggttggatttgttgatg

SEQ ID NO: 232215 - DNA, 23 bp, Artificial sequence
  SiRNA target sequence
gtgaaggttggatttgttgatgg

SEQ ID NO: 232216 - DNA, 23 bp, Artificial sequence
  SiRNA target sequence
tgaaggttggatttgttgatgga

SEQ ID NO: 232217 - DNA, 23 bp, Artificial sequence
  SiRNA target sequence
gaaggttggatttgttgatggac

SEQ ID NO: 232218 - DNA, 23 bp, Artificial sequence
  SiRNA target sequence
aaggttggatttgttgatggact

SEQ ID NO: 232219 - DNA, 23 bp, Artificial sequence
  SiRNA target sequence
aggttggatttgttgatggactt

SEQ ID NO: 232220 - DNA, 23 bp, Artificial sequence
  SiRNA target sequence
ggttggatttgttgatggactta

SEQ ID NO: 232221 - DNA, 23 bp, Artificial sequence
  SiRNA target sequence
gttggatttgttgatggacttat

SEQ ID NO: 232222 - DNA, 23 bp, Artificial sequence
  SiRNA target sequence
ttggatttgttgatggacttatt

SEQ ID NO: 232223 - DNA, 23 bp, Artificial sequence
  SiRNA target sequence
tggatttgttgatggacttattg

SEQ ID NO: 232224 - DNA, 23 bp, Artificial sequence
  SiRNA target sequence
ggatttgttgatggacttattga

SEQ ID NO: 232225 - DNA, 23 bp, Artificial sequence
  SiRNA target sequence
gatttgttgatggacttattgag

SEQ ID NO: 232226 - DNA, 23 bp, Artificial sequence
  SiRNA target sequence
atttgttgatggacttattgaga

SEQ ID NO: 232227 - DNA, 23 bp, Artificial sequence
  SiRNA target sequence
tttgttgatggacttattgagat

SEQ ID NO: 232228 - DNA, 23 bp, Artificial sequence
  SiRNA target sequence
ttgttgatggacttattgagatg

SEQ ID NO: 232229 - DNA, 23 bp, Artificial sequence
  SiRNA target sequence
tgttgatggacttattgagatga

SEQ ID NO: 232230 - DNA, 23 bp, Artificial sequence
  SiRNA target sequence
gttgatggacttattgagatgag

SEQ ID NO: 232231 - DNA, 23 bp, Artificial sequence
  SiRNA target sequence
ttgatggacttattgagatgagt

SEQ ID NO: 232232 - DNA, 23 bp, Artificial sequence
  SiRNA target sequence
tgatggacttattgagatgagta

SEQ ID NO: 232233 - DNA, 23 bp, Artificial sequence
  SiRNA target sequence
gatggacttattgagatgagtaa

SEQ ID NO: 232234 - DNA, 23 bp, Artificial sequence
  SiRNA target sequence
atggacttattgagatgagtaaa

SEQ ID NO: 232235 - DNA, 23 bp, Artificial sequence
  SiRNA target sequence
tggacttattgagatgagtaaat

SEQ ID NO: 232236 - DNA, 23 bp, Artificial sequence
  SiRNA target sequence
ggacttattgagatgagtaaatc

SEQ ID NO: 232237 - DNA, 23 bp, Artificial sequence
  SiRNA target sequence
gacttattgagatgagtaaatct

SEQ ID NO: 232238 - DNA, 23 bp, Artificial sequence
  SiRNA target sequence
acttattgagatgagtaaatcta

SEQ ID NO: 232239 - DNA, 23 bp, Artificial sequence
  SiRNA target sequence
cttattgagatgagtaaatctaa

SEQ ID NO: 232240 - DNA, 23 bp, Artificial sequence
  SiRNA target sequence
ttattgagatgagtaaatctaaa

SEQ ID NO: 232241 - DNA, 23 bp, Artificial sequence
  SiRNA target sequence
tattgagatgagtaaatctaaac

SEQ ID NO: 232242 - DNA, 23 bp, Artificial sequence
  SiRNA target sequence
attgagatgagtaaatctaaact

SEQ ID NO: 232243 - DNA, 23 bp, Artificial sequence
  SiRNA target sequence
ttgagatgagtaaatctaaacta

SEQ ID NO: 232244 - DNA, 23 bp, Artificial sequence
  SiRNA target sequence
tgagatgagtaaatctaaactac

SEQ ID NO: 232245 - DNA, 23 bp, Artificial sequence
  SiRNA target sequence
gagatgagtaaatctaaactact

SEQ ID NO: 232246 - DNA, 23 bp, Artificial sequence
  SiRNA target sequence
agatgagtaaatctaaactactg

SEQ ID NO: 232247 - DNA, 23 bp, Artificial sequence
  SiRNA target sequence
gatgagtaaatctaaactactgt

SEQ ID NO: 232248 - DNA, 23 bp, Artificial sequence
  SiRNA target sequence
atgagtaaatctaaactactgtt

SEQ ID NO: 232249 - DNA, 23 bp, Artificial sequence
  SiRNA target sequence
tgagtaaatctaaactactgttg

SEQ ID NO: 232250 - DNA, 23 bp, Artificial sequence
  SiRNA target sequence
gagtaaatctaaactactgttga

SEQ ID NO: 232251 - DNA, 23 bp, Artificial sequence
  SiRNA target sequence
agtaaatctaaactactgttgaa

SEQ ID NO: 232252 - DNA, 23 bp, Artificial sequence
  SiRNA target sequence
gtaaatctaaactactgttgaat

SEQ ID NO: 232253 - DNA, 23 bp, Artificial sequence
  SiRNA target sequence
taaatctaaactactgttgaata

SEQ ID NO: 232254 - DNA, 23 bp, Artificial sequence
  SiRNA target sequence
aaatctaaactactgttgaatat

SEQ ID NO: 232255 - DNA, 23 bp, Artificial sequence
  SiRNA target sequence
aatctaaactactgttgaatatg

SEQ ID NO: 232256 - DNA, 23 bp, Artificial sequence
  SiRNA target sequence
atctaaactactgttgaatatgt

SEQ ID NO: 232257 - DNA, 23 bp, Artificial sequence
  SiRNA target sequence
tctaaactactgttgaatatgtc

SEQ ID NO: 232258 - DNA, 23 bp, Artificial sequence
  SiRNA target sequence
ctaaactactgttgaatatgtca

SEQ ID NO: 232259 - DNA, 23 bp, Artificial sequence
  SiRNA target sequence
taaactactgttgaatatgtcat

SEQ ID NO: 232260 - DNA, 23 bp, Artificial sequence
  SiRNA target sequence
aaactactgttgaatatgtcatt

SEQ ID NO: 232261 - DNA, 23 bp, Artificial sequence
  SiRNA target sequence
aactactgttgaatatgtcatta

SEQ ID NO: 232262 - DNA, 23 bp, Artificial sequence
  SiRNA target sequence
actactgttgaatatgtcattag

SEQ ID NO: 232263 - DNA, 23 bp, Artificial sequence
  SiRNA target sequence
ctactgttgaatatgtcattagt

SEQ ID NO: 232264 - DNA, 23 bp, Artificial sequence
  SiRNA target sequence
tactgttgaatatgtcattagtc

SEQ ID NO: 232265 - DNA, 23 bp, Artificial sequence
  SiRNA target sequence
actgttgaatatgtcattagtcg

SEQ ID NO: 232266 - DNA, 23 bp, Artificial sequence
  SiRNA target sequence
ctgttgaatatgtcattagtcgt

SEQ ID NO: 232267 - DNA, 23 bp, Artificial sequence
  SiRNA target sequence
tgttgaatatgtcattagtcgta

SEQ ID NO: 232268 - DNA, 23 bp, Artificial sequence
  SiRNA target sequence
gttgaatatgtcattagtcgtat

SEQ ID NO: 232269 - DNA, 23 bp, Artificial sequence
  SiRNA target sequence
ttgaatatgtcattagtcgtatt

SEQ ID NO: 232270 - DNA, 23 bp, Artificial sequence
  SiRNA target sequence
tgaatatgtcattagtcgtatta

SEQ ID NO: 232271 - DNA, 23 bp, Artificial sequence
  SiRNA target sequence
gaatatgtcattagtcgtattat

SEQ ID NO: 232272 - DNA, 23 bp, Artificial sequence
  SiRNA target sequence
aatatgtcattagtcgtattatt

SEQ ID NO: 232273 - DNA, 23 bp, Artificial sequence
  SiRNA target sequence
atatgtcattagtcgtattattt

SEQ ID NO: 232274 - DNA, 23 bp, Artificial sequence
  SiRNA target sequence
tatgtcattagtcgtattatttt

SEQ ID NO: 232275 - DNA, 23 bp, Artificial sequence
  SiRNA target sequence
atgtcattagtcgtattatttta

SEQ ID NO: 232276 - DNA, 23 bp, Artificial sequence
  SiRNA target sequence
tgtcattagtcgtattattttat

SEQ ID NO: 232277 - DNA, 23 bp, Artificial sequence
  SiRNA target sequence
gtcattagtcgtattattttatg

SEQ ID NO: 232278 - DNA, 23 bp, Artificial sequence
  SiRNA target sequence
tcattagtcgtattattttatgc

SEQ ID NO: 232279 - DNA, 23 bp, Artificial sequence
  SiRNA target sequence
cattagtcgtattattttatgct

SEQ ID NO: 232280 - DNA, 23 bp, Artificial sequence
  SiRNA target sequence
attagtcgtattattttatgctg

SEQ ID NO: 232281 - DNA, 23 bp, Artificial sequence
  SiRNA target sequence
ttagtcgtattattttatgctgt

SEQ ID NO: 232282 - DNA, 23 bp, Artificial sequence
  SiRNA target sequence
tagtcgtattattttatgctgtt

SEQ ID NO: 232283 - DNA, 23 bp, Artificial sequence
  SiRNA target sequence
agtcgtattattttatgctgttt

SEQ ID NO: 232284 - DNA, 23 bp, Artificial sequence
  SiRNA target sequence
gtcgtattattttatgctgtttc

SEQ ID NO: 232285 - DNA, 23 bp, Artificial sequence
  SiRNA target sequence
tcgtattattttatgctgtttct

SEQ ID NO: 232286 - DNA, 23 bp, Artificial sequence
  SiRNA target sequence
cgtattattttatgctgtttcta

SEQ ID NO: 232287 - DNA, 23 bp, Artificial sequence
  SiRNA target sequence
gtattattttatgctgtttctac

SEQ ID NO: 232288 - DNA, 23 bp, Artificial sequence
  SiRNA target sequence
tattattttatgctgtttctacg

SEQ ID NO: 232289 - DNA, 23 bp, Artificial sequence
  SiRNA target sequence
attattttatgctgtttctacga

SEQ ID NO: 232290 - DNA, 23 bp, Artificial sequence
  SiRNA target sequence
ttattttatgctgtttctacgaa

SEQ ID NO: 232291 - DNA, 23 bp, Artificial sequence
  SiRNA target sequence
tattttatgctgtttctacgaat

SEQ ID NO: 232292 - DNA, 23 bp, Artificial sequence
  SiRNA target sequence
attttatgctgtttctacgaata

SEQ ID NO: 232293 - DNA, 23 bp, Artificial sequence
  SiRNA target sequence
ttttatgctgtttctacgaatat

SEQ ID NO: 232294 - DNA, 23 bp, Artificial sequence
  SiRNA target sequence
tttatgctgtttctacgaatatt

SEQ ID NO: 232295 - DNA, 23 bp, Artificial sequence
  SiRNA target sequence
ttatgctgtttctacgaatatta

SEQ ID NO: 232296 - DNA, 23 bp, Artificial sequence
  SiRNA target sequence
tatgctgtttctacgaatattat

SEQ ID NO: 232297 - DNA, 23 bp, Artificial sequence
  SiRNA target sequence
atgctgtttctacgaatattatt

SEQ ID NO: 232298 - DNA, 23 bp, Artificial sequence
  SiRNA target sequence
tgctgtttctacgaatattattg

SEQ ID NO: 232299 - DNA, 23 bp, Artificial sequence
  SiRNA target sequence
gctgtttctacgaatattattga

SEQ ID NO: 232300 - DNA, 23 bp, Artificial sequence
  SiRNA target sequence
ctgtttctacgaatattattgag

SEQ ID NO: 232301 - DNA, 23 bp, Artificial sequence
  SiRNA target sequence
tgtttctacgaatattattgagt

SEQ ID NO: 232302 - DNA, 23 bp, Artificial sequence
  SiRNA target sequence
gtttctacgaatattattgagtc

SEQ ID NO: 232303 - DNA, 23 bp, Artificial sequence
  SiRNA target sequence
tttctacgaatattattgagtca

SEQ ID NO: 232304 - DNA, 23 bp, Artificial sequence
  SiRNA target sequence
ttctacgaatattattgagtcag

SEQ ID NO: 232305 - DNA, 23 bp, Artificial sequence
  SiRNA target sequence
tctacgaatattattgagtcagc

SEQ ID NO: 232306 - DNA, 23 bp, Artificial sequence
  SiRNA target sequence
ctacgaatattattgagtcagct

SEQ ID NO: 232307 - DNA, 23 bp, Artificial sequence
  SiRNA target sequence
tacgaatattattgagtcagctt

SEQ ID NO: 232308 - DNA, 23 bp, Artificial sequence
  SiRNA target sequence
acgaatattattgagtcagctta

SEQ ID NO: 232309 - DNA, 23 bp, Artificial sequence
  SiRNA target sequence
cgaatattattgagtcagcttat

SEQ ID NO: 232310 - DNA, 23 bp, Artificial sequence
  SiRNA target sequence
gaatattattgagtcagcttata

SEQ ID NO: 232311 - DNA, 23 bp, Artificial sequence
  SiRNA target sequence
aatattattgagtcagcttataa

SEQ ID NO: 232312 - DNA, 23 bp, Artificial sequence
  SiRNA target sequence
atattattgagtcagcttataaa

SEQ ID NO: 232313 - DNA, 23 bp, Artificial sequence
  SiRNA target sequence
tattattgagtcagcttataaat

SEQ ID NO: 232314 - DNA, 23 bp, Artificial sequence
  SiRNA target sequence
attattgagtcagcttataaatc

SEQ ID NO: 232315 - DNA, 23 bp, Artificial sequence
  SiRNA target sequence
ttattgagtcagcttataaatct

SEQ ID NO: 232316 - DNA, 23 bp, Artificial sequence
  SiRNA target sequence
tattgagtcagcttataaatctg

SEQ ID NO: 232317 - DNA, 23 bp, Artificial sequence
  SiRNA target sequence
attgagtcagcttataaatctgc

SEQ ID NO: 232318 - DNA, 23 bp, Artificial sequence
  SiRNA target sequence
ttgagtcagcttataaatctgct

SEQ ID NO: 232319 - DNA, 23 bp, Artificial sequence
  SiRNA target sequence
tgagtcagcttataaatctgctt

SEQ ID NO: 232320 - DNA, 23 bp, Artificial sequence
  SiRNA target sequence
gagtcagcttataaatctgcttt

SEQ ID NO: 232321 - DNA, 23 bp, Artificial sequence
  SiRNA target sequence
agtcagcttataaatctgcttta

SEQ ID NO: 232322 - DNA, 23 bp, Artificial sequence
  SiRNA target sequence
gtcagcttataaatctgctttag

SEQ ID NO: 232323 - DNA, 23 bp, Artificial sequence
  SiRNA target sequence
tcagcttataaatctgctttagc

SEQ ID NO: 232324 - DNA, 23 bp, Artificial sequence
  SiRNA target sequence
cagcttataaatctgctttagct

SEQ ID NO: 232325 - DNA, 23 bp, Artificial sequence
  SiRNA target sequence
agcttataaatctgctttagctg

SEQ ID NO: 232326 - DNA, 23 bp, Artificial sequence
  SiRNA target sequence
gcttataaatctgctttagctgt

SEQ ID NO: 232327 - DNA, 23 bp, Artificial sequence
  SiRNA target sequence
cttataaatctgctttagctgtc

SEQ ID NO: 232328 - DNA, 23 bp, Artificial sequence
  SiRNA target sequence
ttataaatctgctttagctgtcg

SEQ ID NO: 232329 - DNA, 23 bp, Artificial sequence
  SiRNA target sequence
tataaatctgctttagctgtcgg

SEQ ID NO: 232330 - DNA, 23 bp, Artificial sequence
  SiRNA target sequence
ataaatctgctttagctgtcggt

SEQ ID NO: 232331 - DNA, 23 bp, Artificial sequence
  SiRNA target sequence
taaatctgctttagctgtcggtg

SEQ ID NO: 232332 - DNA, 23 bp, Artificial sequence
  SiRNA target sequence
aaatctgctttagctgtcggtgc

SEQ ID NO: 232333 - DNA, 23 bp, Artificial sequence
  SiRNA target sequence
aatctgctttagctgtcggtgct

SEQ ID NO: 232334 - DNA, 23 bp, Artificial sequence
  SiRNA target sequence
atctgctttagctgtcggtgcta

SEQ ID NO: 232335 - DNA, 23 bp, Artificial sequence
  SiRNA target sequence
tctgctttagctgtcggtgctaa

SEQ ID NO: 232336 - DNA, 23 bp, Artificial sequence
  SiRNA target sequence
ctgctttagctgtcggtgctaat

SEQ ID NO: 232337 - DNA, 23 bp, Artificial sequence
  SiRNA target sequence
tgctttagctgtcggtgctaatg

SEQ ID NO: 232338 - DNA, 23 bp, Artificial sequence
  SiRNA target sequence
gctttagctgtcggtgctaatga

SEQ ID NO: 232339 - DNA, 23 bp, Artificial sequence
  SiRNA target sequence
ctttagctgtcggtgctaatgaa

SEQ ID NO: 232340 - DNA, 23 bp, Artificial sequence
  SiRNA target sequence
tttagctgtcggtgctaatgaaa

SEQ ID NO: 232341 - DNA, 23 bp, Artificial sequence
  SiRNA target sequence
ttagctgtcggtgctaatgaaac

SEQ ID NO: 232342 - DNA, 23 bp, Artificial sequence
  SiRNA target sequence
tagctgtcggtgctaatgaaact

SEQ ID NO: 232343 - DNA, 23 bp, Artificial sequence
  SiRNA target sequence
agctgtcggtgctaatgaaactg

SEQ ID NO: 232344 - DNA, 23 bp, Artificial sequence
  SiRNA target sequence
gctgtcggtgctaatgaaactgg

SEQ ID NO: 232345 - DNA, 23 bp, Artificial sequence
  SiRNA target sequence
ctgtcggtgctaatgaaactggt

SEQ ID NO: 232346 - DNA, 23 bp, Artificial sequence
  SiRNA target sequence
tgtcggtgctaatgaaactggtg

SEQ ID NO: 232347 - DNA, 23 bp, Artificial sequence
  SiRNA target sequence
gtcggtgctaatgaaactggtga

SEQ ID NO: 232348 - DNA, 23 bp, Artificial sequence
  SiRNA target sequence
tcggtgctaatgaaactggtgag

SEQ ID NO: 232349 - DNA, 23 bp, Artificial sequence
  SiRNA target sequence
cggtgctaatgaaactggtgagg

SEQ ID NO: 232350 - DNA, 23 bp, Artificial sequence
  SiRNA target sequence
ggtgctaatgaaactggtgaggc

SEQ ID NO: 232351 - DNA, 23 bp, Artificial sequence
  SiRNA target sequence
gtgctaatgaaactggtgaggca

SEQ ID NO: 232352 - DNA, 23 bp, Artificial sequence
  SiRNA target sequence
tgctaatgaaactggtgaggcaa

SEQ ID NO: 232353 - DNA, 23 bp, Artificial sequence
  SiRNA target sequence
gctaatgaaactggtgaggcaaa

SEQ ID NO: 232354 - DNA, 23 bp, Artificial sequence
  SiRNA target sequence
ctaatgaaactggtgaggcaaaa

SEQ ID NO: 232355 - DNA, 23 bp, Artificial sequence
  SiRNA target sequence
taatgaaactggtgaggcaaaat

SEQ ID NO: 232356 - DNA, 23 bp, Artificial sequence
  SiRNA target sequence
aatgaaactggtgaggcaaaatc

SEQ ID NO: 232357 - DNA, 23 bp, Artificial sequence
  SiRNA target sequence
atgaaactggtgaggcaaaatct

SEQ ID NO: 232358 - DNA, 23 bp, Artificial sequence
  SiRNA target sequence
tgaaactggtgaggcaaaatcta

SEQ ID NO: 232359 - DNA, 23 bp, Artificial sequence
  SiRNA target sequence
gaaactggtgaggcaaaatctac

SEQ ID NO: 232360 - DNA, 23 bp, Artificial sequence
  SiRNA target sequence
aaactggtgaggcaaaatctacc

SEQ ID NO: 232361 - DNA, 23 bp, Artificial sequence
  SiRNA target sequence
aactggtgaggcaaaatctacct

SEQ ID NO: 232362 - DNA, 23 bp, Artificial sequence
  SiRNA target sequence
actggtgaggcaaaatctaccta

SEQ ID NO: 232363 - DNA, 23 bp, Artificial sequence
  SiRNA target sequence
ctggtgaggcaaaatctacctat

SEQ ID NO: 232364 - DNA, 23 bp, Artificial sequence
  SiRNA target sequence
tggtgaggcaaaatctacctatg

SEQ ID NO: 232365 - DNA, 23 bp, Artificial sequence
  SiRNA target sequence
ggtgaggcaaaatctacctatgc

SEQ ID NO: 232366 - DNA, 23 bp, Artificial sequence
  SiRNA target sequence
gtgaggcaaaatctacctatgct

SEQ ID NO: 232367 - DNA, 23 bp, Artificial sequence
  SiRNA target sequence
tgaggcaaaatctacctatgctt

SEQ ID NO: 232368 - DNA, 23 bp, Artificial sequence
  SiRNA target sequence
gaggcaaaatctacctatgcttc

SEQ ID NO: 232369 - DNA, 23 bp, Artificial sequence
  SiRNA target sequence
aggcaaaatctacctatgcttca

SEQ ID NO: 232370 - DNA, 23 bp, Artificial sequence
  SiRNA target sequence
ggcaaaatctacctatgcttcaa

SEQ ID NO: 232371 - DNA, 23 bp, Artificial sequence
  SiRNA target sequence
gcaaaatctacctatgcttcaat

SEQ ID NO: 232372 - DNA, 23 bp, Artificial sequence
  SiRNA target sequence
caaaatctacctatgcttcaatt

SEQ ID NO: 232373 - DNA, 23 bp, Artificial sequence
  SiRNA target sequence
aaaatctacctatgcttcaattt

SEQ ID NO: 232374 - DNA, 23 bp, Artificial sequence
  SiRNA target sequence
aaatctacctatgcttcaattta

SEQ ID NO: 232375 - DNA, 23 bp, Artificial sequence
  SiRNA target sequence
aatctacctatgcttcaatttat

SEQ ID NO: 232376 - DNA, 23 bp, Artificial sequence
  SiRNA target sequence
atctacctatgcttcaatttata

SEQ ID NO: 232377 - DNA, 23 bp, Artificial sequence
  SiRNA target sequence
tctacctatgcttcaatttatac

SEQ ID NO: 232378 - DNA, 23 bp, Artificial sequence
  SiRNA target sequence
ctacctatgcttcaatttataca

SEQ ID NO: 232379 - DNA, 23 bp, Artificial sequence
  SiRNA target sequence
tacctatgcttcaatttatacat

SEQ ID NO: 232380 - DNA, 23 bp, Artificial sequence
  SiRNA target sequence
acctatgcttcaatttatacatc

SEQ ID NO: 232381 - DNA, 23 bp, Artificial sequence
  SiRNA target sequence
cctatgcttcaatttatacatca

SEQ ID NO: 232382 - DNA, 23 bp, Artificial sequence
  SiRNA target sequence
ctatgcttcaatttatacatcaa

SEQ ID NO: 232383 - DNA, 23 bp, Artificial sequence
  SiRNA target sequence
tatgcttcaatttatacatcaat

SEQ ID NO: 232384 - DNA, 23 bp, Artificial sequence
  SiRNA target sequence
atgcttcaatttatacatcaatt

SEQ ID NO: 232385 - DNA, 23 bp, Artificial sequence
  SiRNA target sequence
tgcttcaatttatacatcaattg

SEQ ID NO: 232386 - DNA, 23 bp, Artificial sequence
  SiRNA target sequence
gcttcaatttatacatcaattga

SEQ ID NO: 232387 - DNA, 23 bp, Artificial sequence
  SiRNA target sequence
cttcaatttatacatcaattgaa

SEQ ID NO: 232388 - DNA, 23 bp, Artificial sequence
  SiRNA target sequence
ttcaatttatacatcaattgaac

SEQ ID NO: 232389 - DNA, 23 bp, Artificial sequence
  SiRNA target sequence
tcaatttatacatcaattgaaca

SEQ ID NO: 232390 - DNA, 23 bp, Artificial sequence
  SiRNA target sequence
caatttatacatcaattgaacaa

SEQ ID NO: 232391 - DNA, 23 bp, Artificial sequence
  SiRNA target sequence
aatttatacatcaattgaacaat

SEQ ID NO: 232392 - DNA, 23 bp, Artificial sequence
  SiRNA target sequence
atttatacatcaattgaacaatc

SEQ ID NO: 232393 - DNA, 23 bp, Artificial sequence
  SiRNA target sequence
tttatacatcaattgaacaatct

SEQ ID NO: 232394 - DNA, 23 bp, Artificial sequence
  SiRNA target sequence
ttatacatcaattgaacaatctg

SEQ ID NO: 232395 - DNA, 23 bp, Artificial sequence
  SiRNA target sequence
tatacatcaattgaacaatctgg

SEQ ID NO: 232396 - DNA, 23 bp, Artificial sequence
  SiRNA target sequence
atacatcaattgaacaatctgga

SEQ ID NO: 232397 - DNA, 23 bp, Artificial sequence
  SiRNA target sequence
tacatcaattgaacaatctggag

SEQ ID NO: 232398 - DNA, 23 bp, Artificial sequence
  SiRNA target sequence
acatcaattgaacaatctggagt

SEQ ID NO: 232399 - DNA, 23 bp, Artificial sequence
  SiRNA target sequence
catcaattgaacaatctggagtt

SEQ ID NO: 232400 - DNA, 23 bp, Artificial sequence
  SiRNA target sequence
atcaattgaacaatctggagttg

SEQ ID NO: 232401 - DNA, 23 bp, Artificial sequence
  SiRNA target sequence
tcaattgaacaatctggagttgc

SEQ ID NO: 232402 - DNA, 23 bp, Artificial sequence
  SiRNA target sequence
caattgaacaatctggagttgct

SEQ ID NO: 232403 - DNA, 23 bp, Artificial sequence
  SiRNA target sequence
aattgaacaatctggagttgctg

SEQ ID NO: 232404 - DNA, 23 bp, Artificial sequence
  SiRNA target sequence
attgaacaatctggagttgctgt

SEQ ID NO: 232405 - DNA, 23 bp, Artificial sequence
  SiRNA target sequence
ttgaacaatctggagttgctgtt

SEQ ID NO: 232406 - DNA, 23 bp, Artificial sequence
  SiRNA target sequence
tgaacaatctggagttgctgtta

SEQ ID NO: 232407 - DNA, 23 bp, Artificial sequence
  SiRNA target sequence
gaacaatctggagttgctgttat

SEQ ID NO: 232408 - DNA, 23 bp, Artificial sequence
  SiRNA target sequence
aacaatctggagttgctgttatt

SEQ ID NO: 232409 - DNA, 23 bp, Artificial sequence
  SiRNA target sequence
acaatctggagttgctgttattg

SEQ ID NO: 232410 - DNA, 23 bp, Artificial sequence
  SiRNA target sequence
caatctggagttgctgttattgt

SEQ ID NO: 232411 - DNA, 23 bp, Artificial sequence
  SiRNA target sequence
aatctggagttgctgttattgtc

SEQ ID NO: 232412 - DNA, 23 bp, Artificial sequence
  SiRNA target sequence
atctggagttgctgttattgtca

SEQ ID NO: 232413 - DNA, 23 bp, Artificial sequence
  SiRNA target sequence
tctggagttgctgttattgtcat

SEQ ID NO: 232414 - DNA, 23 bp, Artificial sequence
  SiRNA target sequence
ctggagttgctgttattgtcatg

SEQ ID NO: 232415 - DNA, 23 bp, Artificial sequence
  SiRNA target sequence
tggagttgctgttattgtcatga

SEQ ID NO: 232416 - DNA, 23 bp, Artificial sequence
  SiRNA target sequence
ggagttgctgttattgtcatgat

SEQ ID NO: 232417 - DNA, 23 bp, Artificial sequence
  SiRNA target sequence
gagttgctgttattgtcatgatt

SEQ ID NO: 232418 - DNA, 23 bp, Artificial sequence
  SiRNA target sequence
agttgctgttattgtcatgattt

SEQ ID NO: 232419 - DNA, 23 bp, Artificial sequence
  SiRNA target sequence
gttgctgttattgtcatgatttt

SEQ ID NO: 232420 - DNA, 23 bp, Artificial sequence
  SiRNA target sequence
ttgctgttattgtcatgattttg

SEQ ID NO: 232421 - DNA, 23 bp, Artificial sequence
  SiRNA target sequence
tgctgttattgtcatgattttgc

SEQ ID NO: 232422 - DNA, 23 bp, Artificial sequence
  SiRNA target sequence
gctgttattgtcatgattttgct

SEQ ID NO: 232423 - DNA, 23 bp, Artificial sequence
  SiRNA target sequence
ctgttattgtcatgattttgcta

SEQ ID NO: 232424 - DNA, 23 bp, Artificial sequence
  SiRNA target sequence
tgttattgtcatgattttgctac

SEQ ID NO: 232425 - DNA, 23 bp, Artificial sequence
  SiRNA target sequence
gttattgtcatgattttgctact

SEQ ID NO: 232426 - DNA, 23 bp, Artificial sequence
  SiRNA target sequence
ttattgtcatgattttgctactt

SEQ ID NO: 232427 - DNA, 23 bp, Artificial sequence
  SiRNA target sequence
tattgtcatgattttgctactta

SEQ ID NO: 232428 - DNA, 23 bp, Artificial sequence
  SiRNA target sequence
attgtcatgattttgctacttac

SEQ ID NO: 232429 - DNA, 23 bp, Artificial sequence
  SiRNA target sequence
ttgtcatgattttgctacttacc

SEQ ID NO: 232430 - DNA, 23 bp, Artificial sequence
  SiRNA target sequence
tgtcatgattttgctacttaccc

SEQ ID NO: 232431 - DNA, 23 bp, Artificial sequence
  SiRNA target sequence
gtcatgattttgctacttacccc

SEQ ID NO: 232432 - DNA, 23 bp, Artificial sequence
  SiRNA target sequence
tcatgattttgctacttacccct

SEQ ID NO: 232433 - DNA, 23 bp, Artificial sequence
  SiRNA target sequence
catgattttgctacttacccctt

SEQ ID NO: 232434 - DNA, 23 bp, Artificial sequence
  SiRNA target sequence
atgattttgctacttaccccttt

SEQ ID NO: 232435 - DNA, 23 bp, Artificial sequence
  SiRNA target sequence
tgattttgctacttacccctttt

SEQ ID NO: 232436 - DNA, 23 bp, Artificial sequence
  SiRNA target sequence
gattttgctacttaccccttttc

SEQ ID NO: 232437 - DNA, 23 bp, Artificial sequence
  SiRNA target sequence
attttgctacttaccccttttcc

SEQ ID NO: 232438 - DNA, 23 bp, Artificial sequence
  SiRNA target sequence
ttttgctacttaccccttttcca

SEQ ID NO: 232439 - DNA, 23 bp, Artificial sequence
  SiRNA target sequence
tttgctacttaccccttttccaa

SEQ ID NO: 232440 - DNA, 23 bp, Artificial sequence
  SiRNA target sequence
ttgctacttaccccttttccaag

SEQ ID NO: 232441 - DNA, 23 bp, Artificial sequence
  SiRNA target sequence
tgctacttaccccttttccaagg

SEQ ID NO: 232442 - DNA, 23 bp, Artificial sequence
  SiRNA target sequence
gctacttaccccttttccaaggc

SEQ ID NO: 232443 - DNA, 23 bp, Artificial sequence
  SiRNA target sequence
ctacttaccccttttccaaggct

SEQ ID NO: 232444 - DNA, 23 bp, Artificial sequence
  SiRNA target sequence
tacttaccccttttccaaggctt

SEQ ID NO: 232445 - DNA, 23 bp, Artificial sequence
  SiRNA target sequence
acttaccccttttccaaggctta

SEQ ID NO: 232446 - DNA, 23 bp, Artificial sequence
  SiRNA target sequence
cttaccccttttccaaggcttat

SEQ ID NO: 232447 - DNA, 23 bp, Artificial sequence
  SiRNA target sequence
ttaccccttttccaaggcttatt

SEQ ID NO: 232448 - DNA, 23 bp, Artificial sequence
  SiRNA target sequence
taccccttttccaaggcttatta

SEQ ID NO: 232449 - DNA, 23 bp, Artificial sequence
  SiRNA target sequence
accccttttccaaggcttattaa

SEQ ID NO: 232450 - DNA, 23 bp, Artificial sequence
  SiRNA target sequence
ccccttttccaaggcttattaaa

SEQ ID NO: 232451 - DNA, 23 bp, Artificial sequence
  SiRNA target sequence
cccttttccaaggcttattaaaa

SEQ ID NO: 232452 - DNA, 23 bp, Artificial sequence
  SiRNA target sequence
ccttttccaaggcttattaaaac

SEQ ID NO: 232453 - DNA, 23 bp, Artificial sequence
  SiRNA target sequence
cttttccaaggcttattaaaaca

SEQ ID NO: 232454 - DNA, 23 bp, Artificial sequence
  SiRNA target sequence
ttttccaaggcttattaaaacaa

SEQ ID NO: 232455 - DNA, 23 bp, Artificial sequence
  SiRNA target sequence
tttccaaggcttattaaaacaaa

SEQ ID NO: 232456 - DNA, 23 bp, Artificial sequence
  SiRNA target sequence
ttccaaggcttattaaaacaaaa

SEQ ID NO: 232457 - DNA, 23 bp, Artificial sequence
  SiRNA target sequence
tccaaggcttattaaaacaaaag

SEQ ID NO: 232458 - DNA, 23 bp, Artificial sequence
  SiRNA target sequence
ccaaggcttattaaaacaaaagg

SEQ ID NO: 232459 - DNA, 23 bp, Artificial sequence
  SiRNA target sequence
caaggcttattaaaacaaaagga

SEQ ID NO: 232460 - DNA, 23 bp, Artificial sequence
  SiRNA target sequence
aaggcttattaaaacaaaaggat

SEQ ID NO: 232461 - DNA, 23 bp, Artificial sequence
  SiRNA target sequence
aggcttattaaaacaaaaggatg

SEQ ID NO: 232462 - DNA, 23 bp, Artificial sequence
  SiRNA target sequence
ggcttattaaaacaaaaggatgg

SEQ ID NO: 232463 - DNA, 23 bp, Artificial sequence
  SiRNA target sequence
gcttattaaaacaaaaggatgga

SEQ ID NO: 232464 - DNA, 23 bp, Artificial sequence
  SiRNA target sequence
cttattaaaacaaaaggatggat

SEQ ID NO: 232465 - DNA, 23 bp, Artificial sequence
  SiRNA target sequence
ttattaaaacaaaaggatggatt

SEQ ID NO: 232466 - DNA, 23 bp, Artificial sequence
  SiRNA target sequence
tattaaaacaaaaggatggatta

SEQ ID NO: 232467 - DNA, 23 bp, Artificial sequence
  SiRNA target sequence
attaaaacaaaaggatggattac

SEQ ID NO: 232468 - DNA, 23 bp, Artificial sequence
  SiRNA target sequence
ttaaaacaaaaggatggattaca

SEQ ID NO: 232469 - DNA, 23 bp, Artificial sequence
  SiRNA target sequence
taaaacaaaaggatggattacaa

SEQ ID NO: 232470 - DNA, 23 bp, Artificial sequence
  SiRNA target sequence
aaaacaaaaggatggattacaat

SEQ ID NO: 232471 - DNA, 23 bp, Artificial sequence
  SiRNA target sequence
aaacaaaaggatggattacaata

SEQ ID NO: 232472 - DNA, 23 bp, Artificial sequence
  SiRNA target sequence
aacaaaaggatggattacaatag

SEQ ID NO: 232473 - DNA, 23 bp, Artificial sequence
  SiRNA target sequence
acaaaaggatggattacaatagc

SEQ ID NO: 232474 - DNA, 23 bp, Artificial sequence
  SiRNA target sequence
caaaaggatggattacaatagcc

SEQ ID NO: 232475 - DNA, 23 bp, Artificial sequence
  SiRNA target sequence
aaaaggatggattacaatagcca

SEQ ID NO: 232476 - DNA, 23 bp, Artificial sequence
  SiRNA target sequence
aaaggatggattacaatagccat

SEQ ID NO: 232477 - DNA, 23 bp, Artificial sequence
  SiRNA target sequence
aaggatggattacaatagccatt

SEQ ID NO: 232478 - DNA, 23 bp, Artificial sequence
  SiRNA target sequence
aggatggattacaatagccattc

SEQ ID NO: 232479 - DNA, 23 bp, Artificial sequence
  SiRNA target sequence
ggatggattacaatagccattct

SEQ ID NO: 232480 - DNA, 23 bp, Artificial sequence
  SiRNA target sequence
gatggattacaatagccattcta

SEQ ID NO: 232481 - DNA, 23 bp, Artificial sequence
  SiRNA target sequence
atggattacaatagccattctat

SEQ ID NO: 232482 - DNA, 23 bp, Artificial sequence
  SiRNA target sequence
tggattacaatagccattctatg

SEQ ID NO: 232483 - DNA, 23 bp, Artificial sequence
  SiRNA target sequence
ggattacaatagccattctatgt

SEQ ID NO: 232484 - DNA, 23 bp, Artificial sequence
  SiRNA target sequence
gattacaatagccattctatgtc

SEQ ID NO: 232485 - DNA, 23 bp, Artificial sequence
  SiRNA target sequence
attacaatagccattctatgtcc

SEQ ID NO: 232486 - DNA, 23 bp, Artificial sequence
  SiRNA target sequence
ttacaatagccattctatgtcct

SEQ ID NO: 232487 - DNA, 23 bp, Artificial sequence
  SiRNA target sequence
tacaatagccattctatgtccta

SEQ ID NO: 232488 - DNA, 23 bp, Artificial sequence
  SiRNA target sequence
acaatagccattctatgtcctat

SEQ ID NO: 232489 - DNA, 23 bp, Artificial sequence
  SiRNA target sequence
caatagccattctatgtcctatt

SEQ ID NO: 232490 - DNA, 23 bp, Artificial sequence
  SiRNA target sequence
aatagccattctatgtcctatta

SEQ ID NO: 232491 - DNA, 23 bp, Artificial sequence
  SiRNA target sequence
atagccattctatgtcctattat

SEQ ID NO: 232492 - DNA, 23 bp, Artificial sequence
  SiRNA target sequence
tagccattctatgtcctattatt

SEQ ID NO: 232493 - DNA, 23 bp, Artificial sequence
  SiRNA target sequence
agccattctatgtcctattatta

SEQ ID NO: 232494 - DNA, 23 bp, Artificial sequence
  SiRNA target sequence
gccattctatgtcctattattac

SEQ ID NO: 232495 - DNA, 23 bp, Artificial sequence
  SiRNA target sequence
ccattctatgtcctattattact

SEQ ID NO: 232496 - DNA, 23 bp, Artificial sequence
  SiRNA target sequence
cattctatgtcctattattactt

SEQ ID NO: 232497 - DNA, 23 bp, Artificial sequence
  SiRNA target sequence
attctatgtcctattattacttt

SEQ ID NO: 232498 - DNA, 23 bp, Artificial sequence
  SiRNA target sequence
ttctatgtcctattattactttt

SEQ ID NO: 232499 - DNA, 23 bp, Artificial sequence
  SiRNA target sequence
tctatgtcctattattacttttt

SEQ ID NO: 232500 - DNA, 23 bp, Artificial sequence
  SiRNA target sequence
ctatgtcctattattactttttt

SEQ ID NO: 232501 - DNA, 23 bp, Artificial sequence
  SiRNA target sequence
tatgtcctattattacttttttt

SEQ ID NO: 232502 - DNA, 23 bp, Artificial sequence
  SiRNA target sequence
atgtcctattattactttttttt

SEQ ID NO: 232503 - DNA, 23 bp, Artificial sequence
  SiRNA target sequence
tgtcctattattacttttttttc

SEQ ID NO: 232504 - DNA, 23 bp, Artificial sequence
  SiRNA target sequence
gtcctattattacttttttttct

SEQ ID NO: 232505 - DNA, 23 bp, Artificial sequence
  SiRNA target sequence
tcctattattacttttttttctg

SEQ ID NO: 232506 - DNA, 23 bp, Artificial sequence
  SiRNA target sequence
cctattattacttttttttctgc

SEQ ID NO: 232507 - DNA, 23 bp, Artificial sequence
  SiRNA target sequence
ctattattacttttttttctgct

SEQ ID NO: 232508 - DNA, 23 bp, Artificial sequence
  SiRNA target sequence
tattattacttttttttctgctt

SEQ ID NO: 232509 - DNA, 23 bp, Artificial sequence
  SiRNA target sequence
attattacttttttttctgcttt

SEQ ID NO: 232510 - DNA, 23 bp, Artificial sequence
  SiRNA target sequence
ttattacttttttttctgctttt

SEQ ID NO: 232511 - DNA, 23 bp, Artificial sequence
  SiRNA target sequence
tattacttttttttctgcttttg

SEQ ID NO: 232512 - DNA, 23 bp, Artificial sequence
  SiRNA target sequence
attacttttttttctgcttttgg

SEQ ID NO: 232513 - DNA, 23 bp, Artificial sequence
  SiRNA target sequence
ttacttttttttctgcttttggt

SEQ ID NO: 232514 - DNA, 23 bp, Artificial sequence
  SiRNA target sequence
tacttttttttctgcttttggta

SEQ ID NO: 232515 - DNA, 23 bp, Artificial sequence
  SiRNA target sequence
acttttttttctgcttttggtac

SEQ ID NO: 232516 - DNA, 23 bp, Artificial sequence
  SiRNA target sequence
cttttttttctgcttttggtact

SEQ ID NO: 232517 - DNA, 23 bp, Artificial sequence
  SiRNA target sequence
ttttttttctgcttttggtactt

SEQ ID NO: 232518 - DNA, 23 bp, Artificial sequence
  SiRNA target sequence
tttttttctgcttttggtacttt

SEQ ID NO: 232519 - DNA, 23 bp, Artificial sequence
  SiRNA target sequence
ttttttctgcttttggtactttt

SEQ ID NO: 232520 - DNA, 23 bp, Artificial sequence
  SiRNA target sequence
tttttctgcttttggtacttttg

SEQ ID NO: 232521 - DNA, 23 bp, Artificial sequence
  SiRNA target sequence
ttttctgcttttggtacttttgt

SEQ ID NO: 232522 - DNA, 23 bp, Artificial sequence
  SiRNA target sequence
tttctgcttttggtacttttgta

SEQ ID NO: 232523 - DNA, 23 bp, Artificial sequence
  SiRNA target sequence
ttctgcttttggtacttttgtat

SEQ ID NO: 232524 - DNA, 23 bp, Artificial sequence
  SiRNA target sequence
tctgcttttggtacttttgtatt

SEQ ID NO: 232525 - DNA, 23 bp, Artificial sequence
  SiRNA target sequence
ctgcttttggtacttttgtatta

SEQ ID NO: 232526 - DNA, 23 bp, Artificial sequence
  SiRNA target sequence
tgcttttggtacttttgtattag

SEQ ID NO: 232527 - DNA, 23 bp, Artificial sequence
  SiRNA target sequence
gcttttggtacttttgtattagc

SEQ ID NO: 232528 - DNA, 23 bp, Artificial sequence
  SiRNA target sequence
cttttggtacttttgtattagct

SEQ ID NO: 232529 - DNA, 23 bp, Artificial sequence
  SiRNA target sequence
ttttggtacttttgtattagctt

SEQ ID NO: 232530 - DNA, 23 bp, Artificial sequence
  SiRNA target sequence
tttggtacttttgtattagctta

SEQ ID NO: 232531 - DNA, 23 bp, Artificial sequence
  SiRNA target sequence
ttggtacttttgtattagcttat

SEQ ID NO: 232532 - DNA, 23 bp, Artificial sequence
  SiRNA target sequence
tggtacttttgtattagcttatt

SEQ ID NO: 232533 - DNA, 23 bp, Artificial sequence
  SiRNA target sequence
ggtacttttgtattagcttattt

SEQ ID NO: 232534 - DNA, 23 bp, Artificial sequence
  SiRNA target sequence
gtacttttgtattagcttattta

SEQ ID NO: 232535 - DNA, 23 bp, Artificial sequence
  SiRNA target sequence
tacttttgtattagcttatttaa

SEQ ID NO: 232536 - DNA, 23 bp, Artificial sequence
  SiRNA target sequence
acttttgtattagcttatttaaa

SEQ ID NO: 232537 - DNA, 23 bp, Artificial sequence
  SiRNA target sequence
cttttgtattagcttatttaaac

SEQ ID NO: 232538 - DNA, 23 bp, Artificial sequence
  SiRNA target sequence
ttttgtattagcttatttaaact

SEQ ID NO: 232539 - DNA, 23 bp, Artificial sequence
  SiRNA target sequence
tttgtattagcttatttaaactt

SEQ ID NO: 232540 - DNA, 23 bp, Artificial sequence
  SiRNA target sequence
ttgtattagcttatttaaacttc

SEQ ID NO: 232541 - DNA, 23 bp, Artificial sequence
  SiRNA target sequence
tgtattagcttatttaaacttcc

SEQ ID NO: 232542 - DNA, 23 bp, Artificial sequence
  SiRNA target sequence
gtattagcttatttaaacttccc

SEQ ID NO: 232543 - DNA, 23 bp, Artificial sequence
  SiRNA target sequence
tattagcttatttaaacttccca

SEQ ID NO: 232544 - DNA, 23 bp, Artificial sequence
  SiRNA target sequence
attagcttatttaaacttcccaa

SEQ ID NO: 232545 - DNA, 23 bp, Artificial sequence
  SiRNA target sequence
ttagcttatttaaacttcccaat

SEQ ID NO: 232546 - DNA, 23 bp, Artificial sequence
  SiRNA target sequence
tagcttatttaaacttcccaatt

SEQ ID NO: 232547 - DNA, 23 bp, Artificial sequence
  SiRNA target sequence
agcttatttaaacttcccaatta

SEQ ID NO: 232548 - DNA, 23 bp, Artificial sequence
  SiRNA target sequence
gcttatttaaacttcccaattac

SEQ ID NO: 232549 - DNA, 23 bp, Artificial sequence
  SiRNA target sequence
cttatttaaacttcccaattaca

SEQ ID NO: 232550 - DNA, 23 bp, Artificial sequence
  SiRNA target sequence
ttatttaaacttcccaattacaa

SEQ ID NO: 232551 - DNA, 23 bp, Artificial sequence
  SiRNA target sequence
tatttaaacttcccaattacaaa

SEQ ID NO: 232552 - DNA, 23 bp, Artificial sequence
  SiRNA target sequence
atttaaacttcccaattacaaac

SEQ ID NO: 232553 - DNA, 23 bp, Artificial sequence
  SiRNA target sequence
tttaaacttcccaattacaaaca

SEQ ID NO: 232554 - DNA, 23 bp, Artificial sequence
  SiRNA target sequence
ttaaacttcccaattacaaacaa

SEQ ID NO: 232555 - DNA, 23 bp, Artificial sequence
  SiRNA target sequence
taaacttcccaattacaaacaaa

SEQ ID NO: 232556 - DNA, 23 bp, Artificial sequence
  SiRNA target sequence
aaacttcccaattacaaacaaag

SEQ ID NO: 232557 - DNA, 23 bp, Artificial sequence
  SiRNA target sequence
aacttcccaattacaaacaaaga

SEQ ID NO: 232558 - DNA, 23 bp, Artificial sequence
  SiRNA target sequence
acttcccaattacaaacaaagag

SEQ ID NO: 232559 - DNA, 23 bp, Artificial sequence
  SiRNA target sequence
cttcccaattacaaacaaagagg

SEQ ID NO: 232560 - DNA, 23 bp, Artificial sequence
  SiRNA target sequence
ttcccaattacaaacaaagagga

SEQ ID NO: 232561 - DNA, 23 bp, Artificial sequence
  SiRNA target sequence
tcccaattacaaacaaagaggat

SEQ ID NO: 232562 - DNA, 23 bp, Artificial sequence
  SiRNA target sequence
cccaattacaaacaaagaggata

SEQ ID NO: 232563 - DNA, 23 bp, Artificial sequence
  SiRNA target sequence
ccaattacaaacaaagaggataa

SEQ ID NO: 232564 - DNA, 23 bp, Artificial sequence
  SiRNA target sequence
caattacaaacaaagaggataat

SEQ ID NO: 232565 - DNA, 23 bp, Artificial sequence
  SiRNA target sequence
aattacaaacaaagaggataata

SEQ ID NO: 232566 - DNA, 23 bp, Artificial sequence
  SiRNA target sequence
attacaaacaaagaggataatat

SEQ ID NO: 232567 - DNA, 23 bp, Artificial sequence
  SiRNA target sequence
ttacaaacaaagaggataatata

SEQ ID NO: 232568 - DNA, 23 bp, Artificial sequence
  SiRNA target sequence
tacaaacaaagaggataatatat

SEQ ID NO: 232569 - DNA, 23 bp, Artificial sequence
  SiRNA target sequence
acaaacaaagaggataatatatt

SEQ ID NO: 232570 - DNA, 23 bp, Artificial sequence
  SiRNA target sequence
caaacaaagaggataatatattt

SEQ ID NO: 232571 - DNA, 23 bp, Artificial sequence
  SiRNA target sequence
aaacaaagaggataatatatttg

SEQ ID NO: 232572 - DNA, 23 bp, Artificial sequence
  SiRNA target sequence
aacaaagaggataatatatttga

SEQ ID NO: 232573 - DNA, 23 bp, Artificial sequence
  SiRNA target sequence
acaaagaggataatatatttgat

SEQ ID NO: 232574 - DNA, 23 bp, Artificial sequence
  SiRNA target sequence
caaagaggataatatatttgata

SEQ ID NO: 232575 - DNA, 23 bp, Artificial sequence
  SiRNA target sequence
aaagaggataatatatttgatat

SEQ ID NO: 232576 - DNA, 23 bp, Artificial sequence
  SiRNA target sequence
aagaggataatatatttgatatt

SEQ ID NO: 232577 - DNA, 23 bp, Artificial sequence
  SiRNA target sequence
agaggataatatatttgatattt

SEQ ID NO: 232578 - DNA, 23 bp, Artificial sequence
  SiRNA target sequence
gaggataatatatttgatattta

SEQ ID NO: 232579 - DNA, 23 bp, Artificial sequence
  SiRNA target sequence
aggataatatatttgatatttac

SEQ ID NO: 232580 - DNA, 23 bp, Artificial sequence
  SiRNA target sequence
ggataatatatttgatatttacc

SEQ ID NO: 232581 - DNA, 23 bp, Artificial sequence
  SiRNA target sequence
gataatatatttgatatttaccg

SEQ ID NO: 232582 - DNA, 23 bp, Artificial sequence
  SiRNA target sequence
ataatatatttgatatttaccgt

SEQ ID NO: 232583 - DNA, 23 bp, Artificial sequence
  SiRNA target sequence
taatatatttgatatttaccgtt

SEQ ID NO: 232584 - DNA, 23 bp, Artificial sequence
  SiRNA target sequence
aatatatttgatatttaccgttt

SEQ ID NO: 232585 - DNA, 23 bp, Artificial sequence
  SiRNA target sequence
atatatttgatatttaccgttta

SEQ ID NO: 232586 - DNA, 23 bp, Artificial sequence
  SiRNA target sequence
tatatttgatatttaccgtttac

SEQ ID NO: 232587 - DNA, 23 bp, Artificial sequence
  SiRNA target sequence
atatttgatatttaccgtttacc

SEQ ID NO: 232588 - DNA, 23 bp, Artificial sequence
  SiRNA target sequence
tatttgatatttaccgtttaccg

SEQ ID NO: 232589 - DNA, 23 bp, Artificial sequence
  SiRNA target sequence
atttgatatttaccgtttaccgt

SEQ ID NO: 232590 - DNA, 23 bp, Artificial sequence
  SiRNA target sequence
tttgatatttaccgtttaccgtc

SEQ ID NO: 232591 - DNA, 23 bp, Artificial sequence
  SiRNA target sequence
ttgatatttaccgtttaccgtca

SEQ ID NO: 232592 - DNA, 23 bp, Artificial sequence
  SiRNA target sequence
tgatatttaccgtttaccgtcaa

SEQ ID NO: 232593 - DNA, 23 bp, Artificial sequence
  SiRNA target sequence
gatatttaccgtttaccgtcaac

SEQ ID NO: 232594 - DNA, 23 bp, Artificial sequence
  SiRNA target sequence
atatttaccgtttaccgtcaact

SEQ ID NO: 232595 - DNA, 23 bp, Artificial sequence
  SiRNA target sequence
tatttaccgtttaccgtcaactg

SEQ ID NO: 232596 - DNA, 23 bp, Artificial sequence
  SiRNA target sequence
atttaccgtttaccgtcaactga

SEQ ID NO: 232597 - DNA, 23 bp, Artificial sequence
  SiRNA target sequence
tttaccgtttaccgtcaactgat

SEQ ID NO: 232598 - DNA, 23 bp, Artificial sequence
  SiRNA target sequence
ttaccgtttaccgtcaactgatt

SEQ ID NO: 232599 - DNA, 23 bp, Artificial sequence
  SiRNA target sequence
taccgtttaccgtcaactgattc

SEQ ID NO: 232600 - DNA, 23 bp, Artificial sequence
  SiRNA target sequence
accgtttaccgtcaactgattct

SEQ ID NO: 232601 - DNA, 23 bp, Artificial sequence
  SiRNA target sequence
ccgtttaccgtcaactgattcta

SEQ ID NO: 232602 - DNA, 23 bp, Artificial sequence
  SiRNA target sequence
cgtttaccgtcaactgattctat

SEQ ID NO: 232603 - DNA, 23 bp, Artificial sequence
  SiRNA target sequence
gtttaccgtcaactgattctata

SEQ ID NO: 232604 - DNA, 23 bp, Artificial sequence
  SiRNA target sequence
tttaccgtcaactgattctataa

SEQ ID NO: 232605 - DNA, 23 bp, Artificial sequence
  SiRNA target sequence
ttaccgtcaactgattctataat

SEQ ID NO: 232606 - DNA, 23 bp, Artificial sequence
  SiRNA target sequence
taccgtcaactgattctataatc

SEQ ID NO: 232607 - DNA, 23 bp, Artificial sequence
  SiRNA target sequence
accgtcaactgattctataatca

SEQ ID NO: 232608 - DNA, 23 bp, Artificial sequence
  SiRNA target sequence
ccgtcaactgattctataatcaa

SEQ ID NO: 232609 - DNA, 23 bp, Artificial sequence
  SiRNA target sequence
cgtcaactgattctataatcaaa

SEQ ID NO: 232610 - DNA, 23 bp, Artificial sequence
  SiRNA target sequence
gtcaactgattctataatcaaat

SEQ ID NO: 232611 - DNA, 23 bp, Artificial sequence
  SiRNA target sequence
tcaactgattctataatcaaatt

SEQ ID NO: 232612 - DNA, 23 bp, Artificial sequence
  SiRNA target sequence
caactgattctataatcaaatta

SEQ ID NO: 232613 - DNA, 23 bp, Artificial sequence
  SiRNA target sequence
aactgattctataatcaaattag

SEQ ID NO: 232614 - DNA, 23 bp, Artificial sequence
  SiRNA target sequence
actgattctataatcaaattaga

SEQ ID NO: 232615 - DNA, 23 bp, Artificial sequence
  SiRNA target sequence
ctgattctataatcaaattagaa

SEQ ID NO: 232616 - DNA, 23 bp, Artificial sequence
  SiRNA target sequence
tgattctataatcaaattagaaa

SEQ ID NO: 232617 - DNA, 23 bp, Artificial sequence
  SiRNA target sequence
gattctataatcaaattagaaaa

SEQ ID NO: 232618 - DNA, 23 bp, Artificial sequence
  SiRNA target sequence
attctataatcaaattagaaaat

SEQ ID NO: 232619 - DNA, 23 bp, Artificial sequence
  SiRNA target sequence
ttctataatcaaattagaaaata

SEQ ID NO: 232620 - DNA, 23 bp, Artificial sequence
  SiRNA target sequence
tctataatcaaattagaaaatat

SEQ ID NO: 232621 - DNA, 23 bp, Artificial sequence
  SiRNA target sequence
ctataatcaaattagaaaatatt

SEQ ID NO: 232622 - DNA, 23 bp, Artificial sequence
  SiRNA target sequence
tataatcaaattagaaaatattg

SEQ ID NO: 232623 - DNA, 23 bp, Artificial sequence
  SiRNA target sequence
ataatcaaattagaaaatattgt

SEQ ID NO: 232624 - DNA, 23 bp, Artificial sequence
  SiRNA target sequence
taatcaaattagaaaatattgtt

SEQ ID NO: 232625 - DNA, 23 bp, Artificial sequence
  SiRNA target sequence
aatcaaattagaaaatattgttg

SEQ ID NO: 232626 - DNA, 23 bp, Artificial sequence
  SiRNA target sequence
atcaaattagaaaatattgttgg

SEQ ID NO: 232627 - DNA, 23 bp, Artificial sequence
  SiRNA target sequence
tcaaattagaaaatattgttggt

SEQ ID NO: 232628 - DNA, 23 bp, Artificial sequence
  SiRNA target sequence
caaattagaaaatattgttggtg

SEQ ID NO: 232629 - DNA, 23 bp, Artificial sequence
  SiRNA target sequence
aaattagaaaatattgttggtgt

SEQ ID NO: 232630 - DNA, 23 bp, Artificial sequence
  SiRNA target sequence
aattagaaaatattgttggtgtc

SEQ ID NO: 232631 - DNA, 23 bp, Artificial sequence
  SiRNA target sequence
attagaaaatattgttggtgtca

SEQ ID NO: 232632 - DNA, 23 bp, Artificial sequence
  SiRNA target sequence
ttagaaaatattgttggtgtcat

SEQ ID NO: 232633 - DNA, 23 bp, Artificial sequence
  SiRNA target sequence
tagaaaatattgttggtgtcatt

SEQ ID NO: 232634 - DNA, 23 bp, Artificial sequence
  SiRNA target sequence
agaaaatattgttggtgtcattt

SEQ ID NO: 232635 - DNA, 23 bp, Artificial sequence
  SiRNA target sequence
gaaaatattgttggtgtcatttg

SEQ ID NO: 232636 - DNA, 23 bp, Artificial sequence
  SiRNA target sequence
aaaatattgttggtgtcatttgt

SEQ ID NO: 232637 - DNA, 23 bp, Artificial sequence
  SiRNA target sequence
aaatattgttggtgtcatttgtg

SEQ ID NO: 232638 - DNA, 23 bp, Artificial sequence
  SiRNA target sequence
aatattgttggtgtcatttgtgt

SEQ ID NO: 232639 - DNA, 23 bp, Artificial sequence
  SiRNA target sequence
atattgttggtgtcatttgtgta

SEQ ID NO: 232640 - DNA, 23 bp, Artificial sequence
  SiRNA target sequence
tattgttggtgtcatttgtgtat

SEQ ID NO: 232641 - DNA, 23 bp, Artificial sequence
  SiRNA target sequence
attgttggtgtcatttgtgtatc

SEQ ID NO: 232642 - DNA, 23 bp, Artificial sequence
  SiRNA target sequence
ttgttggtgtcatttgtgtatct

SEQ ID NO: 232643 - DNA, 23 bp, Artificial sequence
  SiRNA target sequence
tgttggtgtcatttgtgtatctt

SEQ ID NO: 232644 - DNA, 23 bp, Artificial sequence
  SiRNA target sequence
gttggtgtcatttgtgtatcttt

SEQ ID NO: 232645 - DNA, 23 bp, Artificial sequence
  SiRNA target sequence
ttggtgtcatttgtgtatcttta

SEQ ID NO: 232646 - DNA, 23 bp, Artificial sequence
  SiRNA target sequence
tggtgtcatttgtgtatctttaa

SEQ ID NO: 232647 - DNA, 23 bp, Artificial sequence
  SiRNA target sequence
ggtgtcatttgtgtatctttaat

SEQ ID NO: 232648 - DNA, 23 bp, Artificial sequence
  SiRNA target sequence
gtgtcatttgtgtatctttaatg

SEQ ID NO: 232649 - DNA, 23 bp, Artificial sequence
  SiRNA target sequence
tgtcatttgtgtatctttaatga

SEQ ID NO: 232650 - DNA, 23 bp, Artificial sequence
  SiRNA target sequence
gtcatttgtgtatctttaatgaa

SEQ ID NO: 232651 - DNA, 23 bp, Artificial sequence
  SiRNA target sequence
tcatttgtgtatctttaatgaag

SEQ ID NO: 232652 - DNA, 23 bp, Artificial sequence
  SiRNA target sequence
catttgtgtatctttaatgaaga

SEQ ID NO: 232653 - DNA, 23 bp, Artificial sequence
  SiRNA target sequence
atttgtgtatctttaatgaagat

SEQ ID NO: 232654 - DNA, 23 bp, Artificial sequence
  SiRNA target sequence
tttgtgtatctttaatgaagatt

SEQ ID NO: 232655 - DNA, 23 bp, Artificial sequence
  SiRNA target sequence
ttgtgtatctttaatgaagattt

SEQ ID NO: 232656 - DNA, 23 bp, Artificial sequence
  SiRNA target sequence
tgtgtatctttaatgaagatttc

SEQ ID NO: 232657 - DNA, 23 bp, Artificial sequence
  SiRNA target sequence
gtgtatctttaatgaagatttct

SEQ ID NO: 232658 - DNA, 23 bp, Artificial sequence
  SiRNA target sequence
tgtatctttaatgaagatttcta

SEQ ID NO: 232659 - DNA, 23 bp, Artificial sequence
  SiRNA target sequence
gtatctttaatgaagatttctaa

SEQ ID NO: 232660 - DNA, 23 bp, Artificial sequence
  SiRNA target sequence
tatctttaatgaagatttctaaa

SEQ ID NO: 232661 - DNA, 23 bp, Artificial sequence
  SiRNA target sequence
atctttaatgaagatttctaaat

SEQ ID NO: 232662 - DNA, 23 bp, Artificial sequence
  SiRNA target sequence
tctttaatgaagatttctaaata

SEQ ID NO: 232663 - DNA, 23 bp, Artificial sequence
  SiRNA target sequence
ctttaatgaagatttctaaatat

SEQ ID NO: 232664 - DNA, 23 bp, Artificial sequence
  SiRNA target sequence
tttaatgaagatttctaaatatg

SEQ ID NO: 232665 - DNA, 23 bp, Artificial sequence
  SiRNA target sequence
ttaatgaagatttctaaatatgc

SEQ ID NO: 232666 - DNA, 23 bp, Artificial sequence
  SiRNA target sequence
taatgaagatttctaaatatgca

SEQ ID NO: 232667 - DNA, 23 bp, Artificial sequence
  SiRNA target sequence
aatgaagatttctaaatatgcag

SEQ ID NO: 232668 - DNA, 23 bp, Artificial sequence
  SiRNA target sequence
atgaagatttctaaatatgcagc

SEQ ID NO: 232669 - DNA, 23 bp, Artificial sequence
  SiRNA target sequence
tgaagatttctaaatatgcagca

SEQ ID NO: 232670 - DNA, 23 bp, Artificial sequence
  SiRNA target sequence
gaagatttctaaatatgcagcat

SEQ ID NO: 232671 - DNA, 23 bp, Artificial sequence
  SiRNA target sequence
aagatttctaaatatgcagcatt

SEQ ID NO: 232672 - DNA, 23 bp, Artificial sequence
  SiRNA target sequence
agatttctaaatatgcagcattt

SEQ ID NO: 232673 - DNA, 23 bp, Artificial sequence
  SiRNA target sequence
gatttctaaatatgcagcatttg

SEQ ID NO: 232674 - DNA, 23 bp, Artificial sequence
  SiRNA target sequence
atttctaaatatgcagcatttga

SEQ ID NO: 232675 - DNA, 23 bp, Artificial sequence
  SiRNA target sequence
tttctaaatatgcagcatttgat

SEQ ID NO: 232676 - DNA, 23 bp, Artificial sequence
  SiRNA target sequence
ttctaaatatgcagcatttgata

SEQ ID NO: 232677 - DNA, 23 bp, Artificial sequence
  SiRNA target sequence
tctaaatatgcagcatttgatat

SEQ ID NO: 232678 - DNA, 23 bp, Artificial sequence
  SiRNA target sequence
ctaaatatgcagcatttgatatc

SEQ ID NO: 232679 - DNA, 23 bp, Artificial sequence
  SiRNA target sequence
taaatatgcagcatttgatatca

SEQ ID NO: 232680 - DNA, 23 bp, Artificial sequence
  SiRNA target sequence
aaatatgcagcatttgatatcac

SEQ ID NO: 232681 - DNA, 23 bp, Artificial sequence
  SiRNA target sequence
aatatgcagcatttgatatcaca

SEQ ID NO: 232682 - DNA, 23 bp, Artificial sequence
  SiRNA target sequence
atatgcagcatttgatatcacaa

SEQ ID NO: 232683 - DNA, 23 bp, Artificial sequence
  SiRNA target sequence
tatgcagcatttgatatcacaaa

SEQ ID NO: 232684 - DNA, 23 bp, Artificial sequence
  SiRNA target sequence
atgcagcatttgatatcacaaaa

SEQ ID NO: 232685 - DNA, 23 bp, Artificial sequence
  SiRNA target sequence
tgcagcatttgatatcacaaaag

SEQ ID NO: 232686 - DNA, 23 bp, Artificial sequence
  SiRNA target sequence
gcagcatttgatatcacaaaaga

SEQ ID NO: 232687 - DNA, 23 bp, Artificial sequence
  SiRNA target sequence
cagcatttgatatcacaaaagag

SEQ ID NO: 232688 - DNA, 23 bp, Artificial sequence
  SiRNA target sequence
agcatttgatatcacaaaagagg

SEQ ID NO: 232689 - DNA, 23 bp, Artificial sequence
  SiRNA target sequence
gcatttgatatcacaaaagaggc

SEQ ID NO: 232690 - DNA, 23 bp, Artificial sequence
  SiRNA target sequence
catttgatatcacaaaagaggct

SEQ ID NO: 232691 - DNA, 23 bp, Artificial sequence
  SiRNA target sequence
atttgatatcacaaaagaggctt

SEQ ID NO: 232692 - DNA, 23 bp, Artificial sequence
  SiRNA target sequence
tttgatatcacaaaagaggcttt

SEQ ID NO: 232693 - DNA, 23 bp, Artificial sequence
  SiRNA target sequence
ttgatatcacaaaagaggctttg

SEQ ID NO: 232694 - DNA, 23 bp, Artificial sequence
  SiRNA target sequence
tgatatcacaaaagaggctttgt

SEQ ID NO: 232695 - DNA, 23 bp, Artificial sequence
  SiRNA target sequence
gatatcacaaaagaggctttgtc

SEQ ID NO: 232696 - DNA, 23 bp, Artificial sequence
  SiRNA target sequence
atatcacaaaagaggctttgtct

SEQ ID NO: 232697 - DNA, 23 bp, Artificial sequence
  SiRNA target sequence
tatcacaaaagaggctttgtcta

SEQ ID NO: 232698 - DNA, 23 bp, Artificial sequence
  SiRNA target sequence
atcacaaaagaggctttgtctat

SEQ ID NO: 232699 - DNA, 23 bp, Artificial sequence
  SiRNA target sequence
tcacaaaagaggctttgtctatg

SEQ ID NO: 232700 - DNA, 23 bp, Artificial sequence
  SiRNA target sequence
cacaaaagaggctttgtctatgc

SEQ ID NO: 232701 - DNA, 23 bp, Artificial sequence
  SiRNA target sequence
acaaaagaggctttgtctatgca

SEQ ID NO: 232702 - DNA, 23 bp, Artificial sequence
  SiRNA target sequence
caaaagaggctttgtctatgcag

SEQ ID NO: 232703 - DNA, 23 bp, Artificial sequence
  SiRNA target sequence
aaaagaggctttgtctatgcaga

SEQ ID NO: 232704 - DNA, 23 bp, Artificial sequence
  SiRNA target sequence
aaagaggctttgtctatgcagat

SEQ ID NO: 232705 - DNA, 23 bp, Artificial sequence
  SiRNA target sequence
aagaggctttgtctatgcagatt

SEQ ID NO: 232706 - DNA, 23 bp, Artificial sequence
  SiRNA target sequence
agaggctttgtctatgcagattg

SEQ ID NO: 232707 - DNA, 23 bp, Artificial sequence
  SiRNA target sequence
gaggctttgtctatgcagattga

SEQ ID NO: 232708 - DNA, 23 bp, Artificial sequence
  SiRNA target sequence
aggctttgtctatgcagattgat

SEQ ID NO: 232709 - DNA, 23 bp, Artificial sequence
  SiRNA target sequence
ggctttgtctatgcagattgatg

SEQ ID NO: 232710 - DNA, 23 bp, Artificial sequence
  SiRNA target sequence
gctttgtctatgcagattgatgg

SEQ ID NO: 232711 - DNA, 23 bp, Artificial sequence
  SiRNA target sequence
ctttgtctatgcagattgatggt

SEQ ID NO: 232712 - DNA, 23 bp, Artificial sequence
  SiRNA target sequence
tttgtctatgcagattgatggtt

SEQ ID NO: 232713 - DNA, 23 bp, Artificial sequence
  SiRNA target sequence
ttgtctatgcagattgatggttc

SEQ ID NO: 232714 - DNA, 23 bp, Artificial sequence
  SiRNA target sequence
tgtctatgcagattgatggttct

SEQ ID NO: 232715 - DNA, 23 bp, Artificial sequence
  SiRNA target sequence
gtctatgcagattgatggttcta

SEQ ID NO: 232716 - DNA, 23 bp, Artificial sequence
  SiRNA target sequence
tctatgcagattgatggttctat

SEQ ID NO: 232717 - DNA, 23 bp, Artificial sequence
  SiRNA target sequence
ctatgcagattgatggttctata

SEQ ID NO: 232718 - DNA, 23 bp, Artificial sequence
  SiRNA target sequence
tatgcagattgatggttctataa

SEQ ID NO: 232719 - DNA, 23 bp, Artificial sequence
  SiRNA target sequence
atgcagattgatggttctataag

SEQ ID NO: 232720 - DNA, 23 bp, Artificial sequence
  SiRNA target sequence
tgcagattgatggttctataaga

SEQ ID NO: 232721 - DNA, 23 bp, Artificial sequence
  SiRNA target sequence
gcagattgatggttctataagag

SEQ ID NO: 232722 - DNA, 23 bp, Artificial sequence
  SiRNA target sequence
cagattgatggttctataagagc

SEQ ID NO: 232723 - DNA, 23 bp, Artificial sequence
  SiRNA target sequence
agattgatggttctataagagcg

SEQ ID NO: 232724 - DNA, 23 bp, Artificial sequence
  SiRNA target sequence
gattgatggttctataagagcga

SEQ ID NO: 232725 - DNA, 23 bp, Artificial sequence
  SiRNA target sequence
attgatggttctataagagcgaa

SEQ ID NO: 232726 - DNA, 23 bp, Artificial sequence
  SiRNA target sequence
ttgatggttctataagagcgaaa

SEQ ID NO: 232727 - DNA, 23 bp, Artificial sequence
  SiRNA target sequence
tgatggttctataagagcgaaat

SEQ ID NO: 232728 - DNA, 23 bp, Artificial sequence
  SiRNA target sequence
gatggttctataagagcgaaata

SEQ ID NO: 232729 - DNA, 23 bp, Artificial sequence
  SiRNA target sequence
atggttctataagagcgaaatac

SEQ ID NO: 232730 - DNA, 23 bp, Artificial sequence
  SiRNA target sequence
tggttctataagagcgaaataca

SEQ ID NO: 232731 - DNA, 23 bp, Artificial sequence
  SiRNA target sequence
ggttctataagagcgaaatacaa

SEQ ID NO: 232732 - DNA, 23 bp, Artificial sequence
  SiRNA target sequence
gttctataagagcgaaatacaaa

SEQ ID NO: 232733 - DNA, 23 bp, Artificial sequence
  SiRNA target sequence
ttctataagagcgaaatacaaag

SEQ ID NO: 232734 - DNA, 23 bp, Artificial sequence
  SiRNA target sequence
tctataagagcgaaatacaaagg

SEQ ID NO: 232735 - DNA, 23 bp, Artificial sequence
  SiRNA target sequence
ctataagagcgaaatacaaaggt

SEQ ID NO: 232736 - DNA, 23 bp, Artificial sequence
  SiRNA target sequence
tataagagcgaaatacaaaggta

SEQ ID NO: 232737 - DNA, 23 bp, Artificial sequence
  SiRNA target sequence
ataagagcgaaatacaaaggtat

SEQ ID NO: 232738 - DNA, 23 bp, Artificial sequence
  SiRNA target sequence
taagagcgaaatacaaaggtatt

SEQ ID NO: 232739 - DNA, 23 bp, Artificial sequence
  SiRNA target sequence
aagagcgaaatacaaaggtattt

SEQ ID NO: 232740 - DNA, 23 bp, Artificial sequence
  SiRNA target sequence
agagcgaaatacaaaggtatttt

SEQ ID NO: 232741 - DNA, 23 bp, Artificial sequence
  SiRNA target sequence
gagcgaaatacaaaggtattttt

SEQ ID NO: 232742 - DNA, 23 bp, Artificial sequence
  SiRNA target sequence
agcgaaatacaaaggtatttttg

SEQ ID NO: 232743 - DNA, 23 bp, Artificial sequence
  SiRNA target sequence
gcgaaatacaaaggtatttttga

SEQ ID NO: 232744 - DNA, 23 bp, Artificial sequence
  SiRNA target sequence
cgaaatacaaaggtatttttgat

SEQ ID NO: 232745 - DNA, 23 bp, Artificial sequence
  SiRNA target sequence
gaaatacaaaggtatttttgatg

SEQ ID NO: 232746 - DNA, 23 bp, Artificial sequence
  SiRNA target sequence
aaatacaaaggtatttttgatgg

SEQ ID NO: 232747 - DNA, 23 bp, Artificial sequence
  SiRNA target sequence
aatacaaaggtatttttgatggt

SEQ ID NO: 232748 - DNA, 23 bp, Artificial sequence
  SiRNA target sequence
atacaaaggtatttttgatggtg

SEQ ID NO: 232749 - DNA, 23 bp, Artificial sequence
  SiRNA target sequence
tacaaaggtatttttgatggtgt

SEQ ID NO: 232750 - DNA, 23 bp, Artificial sequence
  SiRNA target sequence
acaaaggtatttttgatggtgta

SEQ ID NO: 232751 - DNA, 23 bp, Artificial sequence
  SiRNA target sequence
caaaggtatttttgatggtgtat

SEQ ID NO: 232752 - DNA, 23 bp, Artificial sequence
  SiRNA target sequence
aaaggtatttttgatggtgtatt

SEQ ID NO: 232753 - DNA, 23 bp, Artificial sequence
  SiRNA target sequence
aaggtatttttgatggtgtattt

SEQ ID NO: 232754 - DNA, 23 bp, Artificial sequence
  SiRNA target sequence
aggtatttttgatggtgtatttg

SEQ ID NO: 232755 - DNA, 23 bp, Artificial sequence
  SiRNA target sequence
ggtatttttgatggtgtatttgg

SEQ ID NO: 232756 - DNA, 23 bp, Artificial sequence
  SiRNA target sequence
gtatttttgatggtgtatttggt

SEQ ID NO: 232757 - DNA, 23 bp, Artificial sequence
  SiRNA target sequence
tatttttgatggtgtatttggta

SEQ ID NO: 232758 - DNA, 23 bp, Artificial sequence
  SiRNA target sequence
atttttgatggtgtatttggtaa

SEQ ID NO: 232759 - DNA, 23 bp, Artificial sequence
  SiRNA target sequence
tttttgatggtgtatttggtaag

SEQ ID NO: 232760 - DNA, 23 bp, Artificial sequence
  SiRNA target sequence
ttttgatggtgtatttggtaagc

SEQ ID NO: 232761 - DNA, 23 bp, Artificial sequence
  SiRNA target sequence
tttgatggtgtatttggtaagct

SEQ ID NO: 232762 - DNA, 23 bp, Artificial sequence
  SiRNA target sequence
ttgatggtgtatttggtaagctg

SEQ ID NO: 232763 - DNA, 23 bp, Artificial sequence
  SiRNA target sequence
tgatggtgtatttggtaagctgg

SEQ ID NO: 232764 - DNA, 23 bp, Artificial sequence
  SiRNA target sequence
gatggtgtatttggtaagctggg

SEQ ID NO: 232765 - DNA, 23 bp, Artificial sequence
  SiRNA target sequence
atggtgtatttggtaagctgggg

SEQ ID NO: 232766 - DNA, 23 bp, Artificial sequence
  SiRNA target sequence
tggtgtatttggtaagctgggga

SEQ ID NO: 232767 - DNA, 23 bp, Artificial sequence
  SiRNA target sequence
ggtgtatttggtaagctggggaa

SEQ ID NO: 232768 - DNA, 23 bp, Artificial sequence
  SiRNA target sequence
gtgtatttggtaagctggggaaa

SEQ ID NO: 232769 - DNA, 23 bp, Artificial sequence
  SiRNA target sequence
tgtatttggtaagctggggaaat

SEQ ID NO: 232770 - DNA, 23 bp, Artificial sequence
  SiRNA target sequence
gtatttggtaagctggggaaatc

SEQ ID NO: 232771 - DNA, 23 bp, Artificial sequence
  SiRNA target sequence
tatttggtaagctggggaaatct

SEQ ID NO: 232772 - DNA, 23 bp, Artificial sequence
  SiRNA target sequence
atttggtaagctggggaaatctt

SEQ ID NO: 232773 - DNA, 23 bp, Artificial sequence
  SiRNA target sequence
tttggtaagctggggaaatcttt

SEQ ID NO: 232774 - DNA, 23 bp, Artificial sequence
  SiRNA target sequence
ttggtaagctggggaaatctttt

SEQ ID NO: 232775 - DNA, 23 bp, Artificial sequence
  SiRNA target sequence
tggtaagctggggaaatcttttg

SEQ ID NO: 232776 - DNA, 23 bp, Artificial sequence
  SiRNA target sequence
ggtaagctggggaaatcttttgg

SEQ ID NO: 232777 - DNA, 23 bp, Artificial sequence
  SiRNA target sequence
gtaagctggggaaatcttttgga

SEQ ID NO: 232778 - DNA, 23 bp, Artificial sequence
  SiRNA target sequence
taagctggggaaatcttttggat

SEQ ID NO: 232779 - DNA, 23 bp, Artificial sequence
  SiRNA target sequence
aagctggggaaatcttttggatc

SEQ ID NO: 232780 - DNA, 23 bp, Artificial sequence
  SiRNA target sequence
agctggggaaatcttttggatca

SEQ ID NO: 232781 - DNA, 23 bp, Artificial sequence
  SiRNA target sequence
gctggggaaatcttttggatcag

SEQ ID NO: 232782 - DNA, 23 bp, Artificial sequence
  SiRNA target sequence
ctggggaaatcttttggatcagt

SEQ ID NO: 232783 - DNA, 23 bp, Artificial sequence
  SiRNA target sequence
tggggaaatcttttggatcagtt

SEQ ID NO: 232784 - DNA, 23 bp, Artificial sequence
  SiRNA target sequence
ggggaaatcttttggatcagttt

SEQ ID NO: 232785 - DNA, 23 bp, Artificial sequence
  SiRNA target sequence
gggaaatcttttggatcagttta

SEQ ID NO: 232786 - DNA, 23 bp, Artificial sequence
  SiRNA target sequence
ggaaatcttttggatcagtttat

SEQ ID NO: 232787 - DNA, 23 bp, Artificial sequence
  SiRNA target sequence
gaaatcttttggatcagtttatg

SEQ ID NO: 232788 - DNA, 23 bp, Artificial sequence
  SiRNA target sequence
aaatcttttggatcagtttatgg

SEQ ID NO: 232789 - DNA, 23 bp, Artificial sequence
  SiRNA target sequence
aatcttttggatcagtttatgga

SEQ ID NO: 232790 - DNA, 23 bp, Artificial sequence
  SiRNA target sequence
atcttttggatcagtttatggat

SEQ ID NO: 232791 - DNA, 23 bp, Artificial sequence
  SiRNA target sequence
tcttttggatcagtttatggatt

SEQ ID NO: 232792 - DNA, 23 bp, Artificial sequence
  SiRNA target sequence
cttttggatcagtttatggattt

SEQ ID NO: 232793 - DNA, 23 bp, Artificial sequence
  SiRNA target sequence
ttttggatcagtttatggattta

SEQ ID NO: 232794 - DNA, 23 bp, Artificial sequence
  SiRNA target sequence
tttggatcagtttatggatttac

SEQ ID NO: 232795 - DNA, 23 bp, Artificial sequence
  SiRNA target sequence
ttggatcagtttatggatttaca

SEQ ID NO: 232796 - DNA, 23 bp, Artificial sequence
  SiRNA target sequence
tggatcagtttatggatttacaa

SEQ ID NO: 232797 - DNA, 23 bp, Artificial sequence
  SiRNA target sequence
ggatcagtttatggatttacaat

SEQ ID NO: 232798 - DNA, 23 bp, Artificial sequence
  SiRNA target sequence
gatcagtttatggatttacaatt

SEQ ID NO: 232799 - DNA, 23 bp, Artificial sequence
  SiRNA target sequence
atcagtttatggatttacaatta

SEQ ID NO: 232800 - DNA, 23 bp, Artificial sequence
  SiRNA target sequence
tcagtttatggatttacaattac

SEQ ID NO: 232801 - DNA, 23 bp, Artificial sequence
  SiRNA target sequence
cagtttatggatttacaattact

SEQ ID NO: 232802 - DNA, 23 bp, Artificial sequence
  SiRNA target sequence
agtttatggatttacaattacta

SEQ ID NO: 232803 - DNA, 23 bp, Artificial sequence
  SiRNA target sequence
gtttatggatttacaattactac

SEQ ID NO: 232804 - DNA, 23 bp, Artificial sequence
  SiRNA target sequence
tttatggatttacaattactaca

SEQ ID NO: 232805 - DNA, 23 bp, Artificial sequence
  SiRNA target sequence
ttatggatttacaattactacat

SEQ ID NO: 232806 - DNA, 23 bp, Artificial sequence
  SiRNA target sequence
tatggatttacaattactacatt

SEQ ID NO: 232807 - DNA, 23 bp, Artificial sequence
  SiRNA target sequence
atggatttacaattactacatta

SEQ ID NO: 232808 - DNA, 23 bp, Artificial sequence
  SiRNA target sequence
tggatttacaattactacattat

SEQ ID NO: 232809 - DNA, 23 bp, Artificial sequence
  SiRNA target sequence
ggatttacaattactacattatt

SEQ ID NO: 232810 - DNA, 23 bp, Artificial sequence
  SiRNA target sequence
gatttacaattactacattatta

SEQ ID NO: 232811 - DNA, 23 bp, Artificial sequence
  SiRNA target sequence
atttacaattactacattattag

SEQ ID NO: 232812 - DNA, 23 bp, Artificial sequence
  SiRNA target sequence
tttacaattactacattattagg

SEQ ID NO: 232813 - DNA, 23 bp, Artificial sequence
  SiRNA target sequence
ttacaattactacattattagga

SEQ ID NO: 232814 - DNA, 23 bp, Artificial sequence
  SiRNA target sequence
tacaattactacattattaggaa

SEQ ID NO: 232815 - DNA, 23 bp, Artificial sequence
  SiRNA target sequence
acaattactacattattaggaac

SEQ ID NO: 232816 - DNA, 23 bp, Artificial sequence
  SiRNA target sequence
caattactacattattaggaaca

SEQ ID NO: 232817 - DNA, 23 bp, Artificial sequence
  SiRNA target sequence
aattactacattattaggaacaa

SEQ ID NO: 232818 - DNA, 23 bp, Artificial sequence
  SiRNA target sequence
attactacattattaggaacaag

SEQ ID NO: 232819 - DNA, 23 bp, Artificial sequence
  SiRNA target sequence
ttactacattattaggaacaaga

SEQ ID NO: 232820 - DNA, 23 bp, Artificial sequence
  SiRNA target sequence
tactacattattaggaacaagag

SEQ ID NO: 232821 - DNA, 23 bp, Artificial sequence
  SiRNA target sequence
actacattattaggaacaagaga

SEQ ID NO: 232822 - DNA, 23 bp, Artificial sequence
  SiRNA target sequence
ctacattattaggaacaagagat

SEQ ID NO: 232823 - DNA, 23 bp, Artificial sequence
  SiRNA target sequence
tacattattaggaacaagagatg

SEQ ID NO: 232824 - DNA, 23 bp, Artificial sequence
  SiRNA target sequence
acattattaggaacaagagatgt

SEQ ID NO: 232825 - DNA, 23 bp, Artificial sequence
  SiRNA target sequence
cattattaggaacaagagatgtt

SEQ ID NO: 232826 - DNA, 23 bp, Artificial sequence
  SiRNA target sequence
attattaggaacaagagatgttc

SEQ ID NO: 232827 - DNA, 23 bp, Artificial sequence
  SiRNA target sequence
ttattaggaacaagagatgttcg

SEQ ID NO: 232828 - DNA, 23 bp, Artificial sequence
  SiRNA target sequence
tattaggaacaagagatgttcgt

SEQ ID NO: 232829 - DNA, 23 bp, Artificial sequence
  SiRNA target sequence
attaggaacaagagatgttcgta

SEQ ID NO: 232830 - DNA, 23 bp, Artificial sequence
  SiRNA target sequence
ttaggaacaagagatgttcgtag

SEQ ID NO: 232831 - DNA, 23 bp, Artificial sequence
  SiRNA target sequence
taggaacaagagatgttcgtaga

SEQ ID NO: 232832 - DNA, 23 bp, Artificial sequence
  SiRNA target sequence
aggaacaagagatgttcgtagag

SEQ ID NO: 232833 - DNA, 23 bp, Artificial sequence
  SiRNA target sequence
ggaacaagagatgttcgtagagg

SEQ ID NO: 232834 - DNA, 23 bp, Artificial sequence
  SiRNA target sequence
gaacaagagatgttcgtagaggt

SEQ ID NO: 232835 - DNA, 23 bp, Artificial sequence
  SiRNA target sequence
aacaagagatgttcgtagaggtg

SEQ ID NO: 232836 - DNA, 23 bp, Artificial sequence
  SiRNA target sequence
acaagagatgttcgtagaggtgc

SEQ ID NO: 232837 - DNA, 23 bp, Artificial sequence
  SiRNA target sequence
caagagatgttcgtagaggtgct

SEQ ID NO: 232838 - DNA, 23 bp, Artificial sequence
  SiRNA target sequence
aagagatgttcgtagaggtgctc

SEQ ID NO: 232839 - DNA, 23 bp, Artificial sequence
  SiRNA target sequence
agagatgttcgtagaggtgctcc

SEQ ID NO: 232840 - DNA, 23 bp, Artificial sequence
  SiRNA target sequence
gagatgttcgtagaggtgctcct

SEQ ID NO: 232841 - DNA, 23 bp, Artificial sequence
  SiRNA target sequence
agatgttcgtagaggtgctccta

SEQ ID NO: 232842 - DNA, 23 bp, Artificial sequence
  SiRNA target sequence
gatgttcgtagaggtgctcctat

SEQ ID NO: 232843 - DNA, 23 bp, Artificial sequence
  SiRNA target sequence
atgttcgtagaggtgctcctata

SEQ ID NO: 232844 - DNA, 23 bp, Artificial sequence
  SiRNA target sequence
tgttcgtagaggtgctcctatat

SEQ ID NO: 232845 - DNA, 23 bp, Artificial sequence
  SiRNA target sequence
gttcgtagaggtgctcctatatc

SEQ ID NO: 232846 - DNA, 23 bp, Artificial sequence
  SiRNA target sequence
ttcgtagaggtgctcctatatcg

SEQ ID NO: 232847 - DNA, 23 bp, Artificial sequence
  SiRNA target sequence
tcgtagaggtgctcctatatcgc

SEQ ID NO: 232848 - DNA, 23 bp, Artificial sequence
  SiRNA target sequence
cgtagaggtgctcctatatcgct

SEQ ID NO: 232849 - DNA, 23 bp, Artificial sequence
  SiRNA target sequence
gtagaggtgctcctatatcgctt

SEQ ID NO: 232850 - DNA, 23 bp, Artificial sequence
  SiRNA target sequence
tagaggtgctcctatatcgcttt

SEQ ID NO: 232851 - DNA, 23 bp, Artificial sequence
  SiRNA target sequence
agaggtgctcctatatcgctttg

SEQ ID NO: 232852 - DNA, 23 bp, Artificial sequence
  SiRNA target sequence
gaggtgctcctatatcgctttgt

SEQ ID NO: 232853 - DNA, 23 bp, Artificial sequence
  SiRNA target sequence
aggtgctcctatatcgctttgtg

SEQ ID NO: 232854 - DNA, 23 bp, Artificial sequence
  SiRNA target sequence
ggtgctcctatatcgctttgtgt

SEQ ID NO: 232855 - DNA, 23 bp, Artificial sequence
  SiRNA target sequence
gtgctcctatatcgctttgtgtt

SEQ ID NO: 232856 - DNA, 23 bp, Artificial sequence
  SiRNA target sequence
tgctcctatatcgctttgtgttc

SEQ ID NO: 232857 - DNA, 23 bp, Artificial sequence
  SiRNA target sequence
gctcctatatcgctttgtgttct

SEQ ID NO: 232858 - DNA, 23 bp, Artificial sequence
  SiRNA target sequence
ctcctatatcgctttgtgttcta

SEQ ID NO: 232859 - DNA, 23 bp, Artificial sequence
  SiRNA target sequence
tcctatatcgctttgtgttctaa

SEQ ID NO: 232860 - DNA, 23 bp, Artificial sequence
  SiRNA target sequence
cctatatcgctttgtgttctaat

SEQ ID NO: 232861 - DNA, 23 bp, Artificial sequence
  SiRNA target sequence
ctatatcgctttgtgttctaata

SEQ ID NO: 232862 - DNA, 23 bp, Artificial sequence
  SiRNA target sequence
tatatcgctttgtgttctaatat

SEQ ID NO: 232863 - DNA, 23 bp, Artificial sequence
  SiRNA target sequence
atatcgctttgtgttctaatatt

SEQ ID NO: 232864 - DNA, 23 bp, Artificial sequence
  SiRNA target sequence
tatcgctttgtgttctaatattg

SEQ ID NO: 232865 - DNA, 23 bp, Artificial sequence
  SiRNA target sequence
atcgctttgtgttctaatattgt

SEQ ID NO: 232866 - DNA, 23 bp, Artificial sequence
  SiRNA target sequence
tcgctttgtgttctaatattgtt

SEQ ID NO: 232867 - DNA, 23 bp, Artificial sequence
  SiRNA target sequence
cgctttgtgttctaatattgttc

SEQ ID NO: 232868 - DNA, 23 bp, Artificial sequence
  SiRNA target sequence
gctttgtgttctaatattgttct

SEQ ID NO: 232869 - DNA, 23 bp, Artificial sequence
  SiRNA target sequence
ctttgtgttctaatattgttctg

SEQ ID NO: 232870 - DNA, 23 bp, Artificial sequence
  SiRNA target sequence
tttgtgttctaatattgttctgc

SEQ ID NO: 232871 - DNA, 23 bp, Artificial sequence
  SiRNA target sequence
ttgtgttctaatattgttctgcc

SEQ ID NO: 232872 - DNA, 23 bp, Artificial sequence
  SiRNA target sequence
tgtgttctaatattgttctgcct

SEQ ID NO: 232873 - DNA, 23 bp, Artificial sequence
  SiRNA target sequence
gtgttctaatattgttctgcctt

SEQ ID NO: 232874 - DNA, 23 bp, Artificial sequence
  SiRNA target sequence
tgttctaatattgttctgcctta

SEQ ID NO: 232875 - DNA, 23 bp, Artificial sequence
  SiRNA target sequence
gttctaatattgttctgccttat

SEQ ID NO: 232876 - DNA, 23 bp, Artificial sequence
  SiRNA target sequence
ttctaatattgttctgccttata

SEQ ID NO: 232877 - DNA, 23 bp, Artificial sequence
  SiRNA target sequence
tctaatattgttctgccttatat

SEQ ID NO: 232878 - DNA, 23 bp, Artificial sequence
  SiRNA target sequence
ctaatattgttctgccttatatg

SEQ ID NO: 232879 - DNA, 23 bp, Artificial sequence
  SiRNA target sequence
taatattgttctgccttatatgg

SEQ ID NO: 232880 - DNA, 23 bp, Artificial sequence
  SiRNA target sequence
aatattgttctgccttatatggt

SEQ ID NO: 232881 - DNA, 23 bp, Artificial sequence
  SiRNA target sequence
atattgttctgccttatatggtt

SEQ ID NO: 232882 - DNA, 23 bp, Artificial sequence
  SiRNA target sequence
tattgttctgccttatatggttt

SEQ ID NO: 232883 - DNA, 23 bp, Artificial sequence
  SiRNA target sequence
attgttctgccttatatggtttt

SEQ ID NO: 232884 - DNA, 23 bp, Artificial sequence
  SiRNA target sequence
ttgttctgccttatatggtttta

SEQ ID NO: 232885 - DNA, 23 bp, Artificial sequence
  SiRNA target sequence
tgttctgccttatatggttttat

SEQ ID NO: 232886 - DNA, 23 bp, Artificial sequence
  SiRNA target sequence
gttctgccttatatggttttatt

SEQ ID NO: 232887 - DNA, 23 bp, Artificial sequence
  SiRNA target sequence
ttctgccttatatggttttattc

SEQ ID NO: 232888 - DNA, 23 bp, Artificial sequence
  SiRNA target sequence
tctgccttatatggttttattct

SEQ ID NO: 232889 - DNA, 23 bp, Artificial sequence
  SiRNA target sequence
ctgccttatatggttttattctg

SEQ ID NO: 232890 - DNA, 23 bp, Artificial sequence
  SiRNA target sequence
tgccttatatggttttattctgt

SEQ ID NO: 232891 - DNA, 23 bp, Artificial sequence
  SiRNA target sequence
gccttatatggttttattctgtt

SEQ ID NO: 232892 - DNA, 23 bp, Artificial sequence
  SiRNA target sequence
ccttatatggttttattctgttt

SEQ ID NO: 232893 - DNA, 23 bp, Artificial sequence
  SiRNA target sequence
cttatatggttttattctgtttt

SEQ ID NO: 232894 - DNA, 23 bp, Artificial sequence
  SiRNA target sequence
ttatatggttttattctgttttc

SEQ ID NO: 232895 - DNA, 23 bp, Artificial sequence
  SiRNA target sequence
tatatggttttattctgttttct

SEQ ID NO: 232896 - DNA, 23 bp, Artificial sequence
  SiRNA target sequence
atatggttttattctgttttcta

SEQ ID NO: 232897 - DNA, 23 bp, Artificial sequence
  SiRNA target sequence
tatggttttattctgttttctat

SEQ ID NO: 232898 - DNA, 23 bp, Artificial sequence
  SiRNA target sequence
atggttttattctgttttctatc

SEQ ID NO: 232899 - DNA, 23 bp, Artificial sequence
  SiRNA target sequence
tggttttattctgttttctatct

SEQ ID NO: 232900 - DNA, 23 bp, Artificial sequence
  SiRNA target sequence
ggttttattctgttttctatctc

SEQ ID NO: 232901 - DNA, 23 bp, Artificial sequence
  SiRNA target sequence
gttttattctgttttctatctca

SEQ ID NO: 232902 - DNA, 23 bp, Artificial sequence
  SiRNA target sequence
ttttattctgttttctatctcaa

SEQ ID NO: 232903 - DNA, 23 bp, Artificial sequence
  SiRNA target sequence
tttattctgttttctatctcaat

SEQ ID NO: 232904 - DNA, 23 bp, Artificial sequence
  SiRNA target sequence
ttattctgttttctatctcaata

SEQ ID NO: 232905 - DNA, 23 bp, Artificial sequence
  SiRNA target sequence
tattctgttttctatctcaatag

SEQ ID NO: 232906 - DNA, 23 bp, Artificial sequence
  SiRNA target sequence
attctgttttctatctcaataga

SEQ ID NO: 232907 - DNA, 23 bp, Artificial sequence
  SiRNA target sequence
ttctgttttctatctcaatagaa

SEQ ID NO: 232908 - DNA, 23 bp, Artificial sequence
  SiRNA target sequence
tctgttttctatctcaatagaaa

SEQ ID NO: 232909 - DNA, 23 bp, Artificial sequence
  SiRNA target sequence
ctgttttctatctcaatagaaaa

SEQ ID NO: 232910 - DNA, 23 bp, Artificial sequence
  SiRNA target sequence
tgttttctatctcaatagaaaat

SEQ ID NO: 232911 - DNA, 23 bp, Artificial sequence
  SiRNA target sequence
gttttctatctcaatagaaaata

SEQ ID NO: 232912 - DNA, 23 bp, Artificial sequence
  SiRNA target sequence
ttttctatctcaatagaaaatat

SEQ ID NO: 232913 - DNA, 23 bp, Artificial sequence
  SiRNA target sequence
tttctatctcaatagaaaatata

SEQ ID NO: 232914 - DNA, 23 bp, Artificial sequence
  SiRNA target sequence
ttctatctcaatagaaaatataa

SEQ ID NO: 232915 - DNA, 23 bp, Artificial sequence
  SiRNA target sequence
tctatctcaatagaaaatataaa

SEQ ID NO: 232916 - DNA, 23 bp, Artificial sequence
  SiRNA target sequence
ctatctcaatagaaaatataaag

SEQ ID NO: 232917 - DNA, 23 bp, Artificial sequence
  SiRNA target sequence
tatctcaatagaaaatataaaga

SEQ ID NO: 232918 - DNA, 23 bp, Artificial sequence
  SiRNA target sequence
atctcaatagaaaatataaagaa

SEQ ID NO: 232919 - DNA, 23 bp, Artificial sequence
  SiRNA target sequence
tctcaatagaaaatataaagaat

SEQ ID NO: 232920 - DNA, 23 bp, Artificial sequence
  SiRNA target sequence
ctcaatagaaaatataaagaatc

SEQ ID NO: 232921 - DNA, 23 bp, Artificial sequence
  SiRNA target sequence
tcaatagaaaatataaagaatct

SEQ ID NO: 232922 - DNA, 23 bp, Artificial sequence
  SiRNA target sequence
caatagaaaatataaagaatctg

SEQ ID NO: 232923 - DNA, 23 bp, Artificial sequence
  SiRNA target sequence
aatagaaaatataaagaatctgt

SEQ ID NO: 232924 - DNA, 23 bp, Artificial sequence
  SiRNA target sequence
atagaaaatataaagaatctgtc

SEQ ID NO: 232925 - DNA, 23 bp, Artificial sequence
  SiRNA target sequence
tagaaaatataaagaatctgtcg

SEQ ID NO: 232926 - DNA, 23 bp, Artificial sequence
  SiRNA target sequence
agaaaatataaagaatctgtcga

SEQ ID NO: 232927 - DNA, 23 bp, Artificial sequence
  SiRNA target sequence
gaaaatataaagaatctgtcgag

SEQ ID NO: 232928 - DNA, 23 bp, Artificial sequence
  SiRNA target sequence
aaaatataaagaatctgtcgaga

SEQ ID NO: 232929 - DNA, 23 bp, Artificial sequence
  SiRNA target sequence
aaatataaagaatctgtcgagaa

SEQ ID NO: 232930 - DNA, 23 bp, Artificial sequence
  SiRNA target sequence
aatataaagaatctgtcgagaat

SEQ ID NO: 232931 - DNA, 23 bp, Artificial sequence
  SiRNA target sequence
atataaagaatctgtcgagaata

SEQ ID NO: 232932 - DNA, 23 bp, Artificial sequence
  SiRNA target sequence
tataaagaatctgtcgagaataa

SEQ ID NO: 232933 - DNA, 23 bp, Artificial sequence
  SiRNA target sequence
ataaagaatctgtcgagaataat

SEQ ID NO: 232934 - DNA, 23 bp, Artificial sequence
  SiRNA target sequence
taaagaatctgtcgagaataatg

SEQ ID NO: 232935 - DNA, 23 bp, Artificial sequence
  SiRNA target sequence
aaagaatctgtcgagaataatgc

SEQ ID NO: 232936 - DNA, 23 bp, Artificial sequence
  SiRNA target sequence
aagaatctgtcgagaataatgca

SEQ ID NO: 232937 - DNA, 23 bp, Artificial sequence
  SiRNA target sequence
agaatctgtcgagaataatgcac

SEQ ID NO: 232938 - DNA, 23 bp, Artificial sequence
  SiRNA target sequence
gaatctgtcgagaataatgcacc

SEQ ID NO: 232939 - DNA, 23 bp, Artificial sequence
  SiRNA target sequence
aatctgtcgagaataatgcacca

SEQ ID NO: 232940 - DNA, 23 bp, Artificial sequence
  SiRNA target sequence
atctgtcgagaataatgcaccaa

SEQ ID NO: 232941 - DNA, 23 bp, Artificial sequence
  SiRNA target sequence
tctgtcgagaataatgcaccaat

SEQ ID NO: 232942 - DNA, 23 bp, Artificial sequence
  SiRNA target sequence
ctgtcgagaataatgcaccaatt

SEQ ID NO: 232943 - DNA, 23 bp, Artificial sequence
  SiRNA target sequence
tgtcgagaataatgcaccaattg

SEQ ID NO: 232944 - DNA, 23 bp, Artificial sequence
  SiRNA target sequence
gtcgagaataatgcaccaattga

SEQ ID NO: 232945 - DNA, 23 bp, Artificial sequence
  SiRNA target sequence
tcgagaataatgcaccaattgat

SEQ ID NO: 232946 - DNA, 23 bp, Artificial sequence
  SiRNA target sequence
cgagaataatgcaccaattgata

SEQ ID NO: 232947 - DNA, 23 bp, Artificial sequence
  SiRNA target sequence
gagaataatgcaccaattgatat

SEQ ID NO: 232948 - DNA, 23 bp, Artificial sequence
  SiRNA target sequence
agaataatgcaccaattgatatt

SEQ ID NO: 232949 - DNA, 23 bp, Artificial sequence
  SiRNA target sequence
gaataatgcaccaattgatattg

SEQ ID NO: 232950 - DNA, 23 bp, Artificial sequence
  SiRNA target sequence
aataatgcaccaattgatattga

SEQ ID NO: 232951 - DNA, 23 bp, Artificial sequence
  SiRNA target sequence
ataatgcaccaattgatattgat

SEQ ID NO: 232952 - DNA, 23 bp, Artificial sequence
  SiRNA target sequence
taatgcaccaattgatattgatt

SEQ ID NO: 232953 - DNA, 23 bp, Artificial sequence
  SiRNA target sequence
aatgcaccaattgatattgattt

SEQ ID NO: 232954 - DNA, 23 bp, Artificial sequence
  SiRNA target sequence
atgcaccaattgatattgattta

SEQ ID NO: 232955 - DNA, 23 bp, Artificial sequence
  SiRNA target sequence
tgcaccaattgatattgatttat

SEQ ID NO: 232956 - DNA, 23 bp, Artificial sequence
  SiRNA target sequence
gcaccaattgatattgatttatt

SEQ ID NO: 232957 - DNA, 23 bp, Artificial sequence
  SiRNA target sequence
caccaattgatattgatttattc

SEQ ID NO: 232958 - DNA, 23 bp, Artificial sequence
  SiRNA target sequence
accaattgatattgatttattca

SEQ ID NO: 232959 - DNA, 23 bp, Artificial sequence
  SiRNA target sequence
ccaattgatattgatttattcac

SEQ ID NO: 232960 - DNA, 23 bp, Artificial sequence
  SiRNA target sequence
caattgatattgatttattcact

SEQ ID NO: 232961 - DNA, 23 bp, Artificial sequence
  SiRNA target sequence
aattgatattgatttattcacta

SEQ ID NO: 232962 - DNA, 23 bp, Artificial sequence
  SiRNA target sequence
attgatattgatttattcactag

SEQ ID NO: 232963 - DNA, 23 bp, Artificial sequence
  SiRNA target sequence
ttgatattgatttattcactagt

SEQ ID NO: 232964 - DNA, 23 bp, Artificial sequence
  SiRNA target sequence
tgatattgatttattcactagtt

SEQ ID NO: 232965 - DNA, 23 bp, Artificial sequence
  SiRNA target sequence
gatattgatttattcactagttc

SEQ ID NO: 232966 - DNA, 23 bp, Artificial sequence
  SiRNA target sequence
atattgatttattcactagttca

SEQ ID NO: 232967 - DNA, 23 bp, Artificial sequence
  SiRNA target sequence
tattgatttattcactagttcaa

SEQ ID NO: 232968 - DNA, 23 bp, Artificial sequence
  SiRNA target sequence
attgatttattcactagttcaaa

SEQ ID NO: 232969 - DNA, 23 bp, Artificial sequence
  SiRNA target sequence
ttgatttattcactagttcaaaa

SEQ ID NO: 232970 - DNA, 23 bp, Artificial sequence
  SiRNA target sequence
tgatttattcactagttcaaaag

SEQ ID NO: 232971 - DNA, 23 bp, Artificial sequence
  SiRNA target sequence
gatttattcactagttcaaaagt

SEQ ID NO: 232972 - DNA, 23 bp, Artificial sequence
  SiRNA target sequence
atttattcactagttcaaaagtc

SEQ ID NO: 232973 - DNA, 23 bp, Artificial sequence
  SiRNA target sequence
tttattcactagttcaaaagtca

SEQ ID NO: 232974 - DNA, 23 bp, Artificial sequence
  SiRNA target sequence
ttattcactagttcaaaagtcaa

SEQ ID NO: 232975 - DNA, 23 bp, Artificial sequence
  SiRNA target sequence
tattcactagttcaaaagtcaag

SEQ ID NO: 232976 - DNA, 23 bp, Artificial sequence
  SiRNA target sequence
attcactagttcaaaagtcaagg

SEQ ID NO: 232977 - DNA, 23 bp, Artificial sequence
  SiRNA target sequence
ttcactagttcaaaagtcaaggc

SEQ ID NO: 232978 - DNA, 23 bp, Artificial sequence
  SiRNA target sequence
tcactagttcaaaagtcaaggca

SEQ ID NO: 232979 - DNA, 23 bp, Artificial sequence
  SiRNA target sequence
cactagttcaaaagtcaaggcac

SEQ ID NO: 232980 - DNA, 23 bp, Artificial sequence
  SiRNA target sequence
actagttcaaaagtcaaggcacc

SEQ ID NO: 232981 - DNA, 23 bp, Artificial sequence
  SiRNA target sequence
ctagttcaaaagtcaaggcacct

SEQ ID NO: 232982 - DNA, 23 bp, Artificial sequence
  SiRNA target sequence
tagttcaaaagtcaaggcacctt

SEQ ID NO: 232983 - DNA, 23 bp, Artificial sequence
  SiRNA target sequence
agttcaaaagtcaaggcaccttc

SEQ ID NO: 232984 - DNA, 23 bp, Artificial sequence
  SiRNA target sequence
gttcaaaagtcaaggcaccttct

SEQ ID NO: 232985 - DNA, 23 bp, Artificial sequence
  SiRNA target sequence
ttcaaaagtcaaggcaccttctt

SEQ ID NO: 232986 - DNA, 23 bp, Artificial sequence
  SiRNA target sequence
tcaaaagtcaaggcaccttcttc

SEQ ID NO: 232987 - DNA, 23 bp, Artificial sequence
  SiRNA target sequence
caaaagtcaaggcaccttcttct

SEQ ID NO: 232988 - DNA, 23 bp, Artificial sequence
  SiRNA target sequence
aaaagtcaaggcaccttcttctg

SEQ ID NO: 232989 - DNA, 23 bp, Artificial sequence
  SiRNA target sequence
aaagtcaaggcaccttcttctga

SEQ ID NO: 232990 - DNA, 23 bp, Artificial sequence
  SiRNA target sequence
aagtcaaggcaccttcttctgaa

SEQ ID NO: 232991 - DNA, 23 bp, Artificial sequence
  SiRNA target sequence
agtcaaggcaccttcttctgaac

SEQ ID NO: 232992 - DNA, 23 bp, Artificial sequence
  SiRNA target sequence
gtcaaggcaccttcttctgaacc

SEQ ID NO: 232993 - DNA, 23 bp, Artificial sequence
  SiRNA target sequence
tcaaggcaccttcttctgaacct

SEQ ID NO: 232994 - DNA, 23 bp, Artificial sequence
  SiRNA target sequence
caaggcaccttcttctgaaccta

SEQ ID NO: 232995 - DNA, 23 bp, Artificial sequence
  SiRNA target sequence
aaggcaccttcttctgaacctac

SEQ ID NO: 232996 - DNA, 23 bp, Artificial sequence
  SiRNA target sequence
aggcaccttcttctgaacctact

SEQ ID NO: 232997 - DNA, 23 bp, Artificial sequence
  SiRNA target sequence
ggcaccttcttctgaacctactg

SEQ ID NO: 232998 - DNA, 23 bp, Artificial sequence
  SiRNA target sequence
gcaccttcttctgaacctactgt

SEQ ID NO: 232999 - DNA, 23 bp, Artificial sequence
  SiRNA target sequence
caccttcttctgaacctactgtt

SEQ ID NO: 233000 - DNA, 23 bp, Artificial sequence
  SiRNA target sequence
accttcttctgaacctactgttg

SEQ ID NO: 233001 - DNA, 23 bp, Artificial sequence
  SiRNA target sequence
ccttcttctgaacctactgttgc

SEQ ID NO: 233002 - DNA, 23 bp, Artificial sequence
  SiRNA target sequence
cttcttctgaacctactgttgct

SEQ ID NO: 233003 - DNA, 23 bp, Artificial sequence
  SiRNA target sequence
ttcttctgaacctactgttgcta

SEQ ID NO: 233004 - DNA, 23 bp, Artificial sequence
  SiRNA target sequence
tcttctgaacctactgttgctac

SEQ ID NO: 233005 - DNA, 23 bp, Artificial sequence
  SiRNA target sequence
cttctgaacctactgttgctacc

SEQ ID NO: 233006 - DNA, 23 bp, Artificial sequence
  SiRNA target sequence
ttctgaacctactgttgctacca

SEQ ID NO: 233007 - DNA, 23 bp, Artificial sequence
  SiRNA target sequence
tctgaacctactgttgctaccaa

SEQ ID NO: 233008 - DNA, 23 bp, Artificial sequence
  SiRNA target sequence
ctgaacctactgttgctaccaaa

SEQ ID NO: 233009 - DNA, 23 bp, Artificial sequence
  SiRNA target sequence
tgaacctactgttgctaccaaaa

SEQ ID NO: 233010 - DNA, 23 bp, Artificial sequence
  SiRNA target sequence
gaacctactgttgctaccaaaag

SEQ ID NO: 233011 - DNA, 23 bp, Artificial sequence
  SiRNA target sequence
aacctactgttgctaccaaaagt

SEQ ID NO: 233012 - DNA, 23 bp, Artificial sequence
  SiRNA target sequence
acctactgttgctaccaaaagtg

SEQ ID NO: 233013 - DNA, 23 bp, Artificial sequence
  SiRNA target sequence
cctactgttgctaccaaaagtgt

SEQ ID NO: 233014 - DNA, 23 bp, Artificial sequence
  SiRNA target sequence
ctactgttgctaccaaaagtgtt

SEQ ID NO: 233015 - DNA, 23 bp, Artificial sequence
  SiRNA target sequence
tactgttgctaccaaaagtgtta

SEQ ID NO: 233016 - DNA, 23 bp, Artificial sequence
  SiRNA target sequence
actgttgctaccaaaagtgttac

SEQ ID NO: 233017 - DNA, 23 bp, Artificial sequence
  SiRNA target sequence
ctgttgctaccaaaagtgttact

SEQ ID NO: 233018 - DNA, 23 bp, Artificial sequence
  SiRNA target sequence
tgttgctaccaaaagtgttacta

SEQ ID NO: 233019 - DNA, 23 bp, Artificial sequence
  SiRNA target sequence
gttgctaccaaaagtgttactac

SEQ ID NO: 233020 - DNA, 23 bp, Artificial sequence
  SiRNA target sequence
ttgctaccaaaagtgttactaca

SEQ ID NO: 233021 - DNA, 23 bp, Artificial sequence
  SiRNA target sequence
tgctaccaaaagtgttactacag

SEQ ID NO: 233022 - DNA, 23 bp, Artificial sequence
  SiRNA target sequence
gctaccaaaagtgttactacaga

SEQ ID NO: 233023 - DNA, 23 bp, Artificial sequence
  SiRNA target sequence
ctaccaaaagtgttactacagaa

SEQ ID NO: 233024 - DNA, 23 bp, Artificial sequence
  SiRNA target sequence
taccaaaagtgttactacagaag

SEQ ID NO: 233025 - DNA, 23 bp, Artificial sequence
  SiRNA target sequence
accaaaagtgttactacagaaga

SEQ ID NO: 233026 - DNA, 23 bp, Artificial sequence
  SiRNA target sequence
ccaaaagtgttactacagaagaa

SEQ ID NO: 233027 - DNA, 23 bp, Artificial sequence
  SiRNA target sequence
caaaagtgttactacagaagaat

SEQ ID NO: 233028 - DNA, 23 bp, Artificial sequence
  SiRNA target sequence
aaaagtgttactacagaagaata

SEQ ID NO: 233029 - DNA, 23 bp, Artificial sequence
  SiRNA target sequence
aaagtgttactacagaagaataa

SEQ ID NO: 233030 - DNA, 24 bp, Artificial sequence
  SiRNA target sequence
atgtcagtagacaattcgaaagtt

SEQ ID NO: 233031 - DNA, 24 bp, Artificial sequence
  SiRNA target sequence
tgtcagtagacaattcgaaagttc

SEQ ID NO: 233032 - DNA, 24 bp, Artificial sequence
  SiRNA target sequence
gtcagtagacaattcgaaagttct

SEQ ID NO: 233033 - DNA, 24 bp, Artificial sequence
  SiRNA target sequence
tcagtagacaattcgaaagttcta

SEQ ID NO: 233034 - DNA, 24 bp, Artificial sequence
  SiRNA target sequence
cagtagacaattcgaaagttctac

SEQ ID NO: 233035 - DNA, 24 bp, Artificial sequence
  SiRNA target sequence
agtagacaattcgaaagttctaca

SEQ ID NO: 233036 - DNA, 24 bp, Artificial sequence
  SiRNA target sequence
gtagacaattcgaaagttctacaa

SEQ ID NO: 233037 - DNA, 24 bp, Artificial sequence
  SiRNA target sequence
tagacaattcgaaagttctacaaa

SEQ ID NO: 233038 - DNA, 24 bp, Artificial sequence
  SiRNA target sequence
agacaattcgaaagttctacaaaa

SEQ ID NO: 233039 - DNA, 24 bp, Artificial sequence
  SiRNA target sequence
gacaattcgaaagttctacaaaat

SEQ ID NO: 233040 - DNA, 24 bp, Artificial sequence
  SiRNA target sequence
acaattcgaaagttctacaaaata

SEQ ID NO: 233041 - DNA, 24 bp, Artificial sequence
  SiRNA target sequence
caattcgaaagttctacaaaataa

SEQ ID NO: 233042 - DNA, 24 bp, Artificial sequence
  SiRNA target sequence
aattcgaaagttctacaaaataac

SEQ ID NO: 233043 - DNA, 24 bp, Artificial sequence
  SiRNA target sequence
attcgaaagttctacaaaataacg

SEQ ID NO: 233044 - DNA, 24 bp, Artificial sequence
  SiRNA target sequence
ttcgaaagttctacaaaataacga

SEQ ID NO: 233045 - DNA, 24 bp, Artificial sequence
  SiRNA target sequence
tcgaaagttctacaaaataacgaa

SEQ ID NO: 233046 - DNA, 24 bp, Artificial sequence
  SiRNA target sequence
cgaaagttctacaaaataacgaaa

SEQ ID NO: 233047 - DNA, 24 bp, Artificial sequence
  SiRNA target sequence
gaaagttctacaaaataacgaaaa

SEQ ID NO: 233048 - DNA, 24 bp, Artificial sequence
  SiRNA target sequence
aaagttctacaaaataacgaaaac

SEQ ID NO: 233049 - DNA, 24 bp, Artificial sequence
  SiRNA target sequence
aagttctacaaaataacgaaaact

SEQ ID NO: 233050 - DNA, 24 bp, Artificial sequence
  SiRNA target sequence
agttctacaaaataacgaaaactc

SEQ ID NO: 233051 - DNA, 24 bp, Artificial sequence
  SiRNA target sequence
gttctacaaaataacgaaaactct

SEQ ID NO: 233052 - DNA, 24 bp, Artificial sequence
  SiRNA target sequence
ttctacaaaataacgaaaactctg

SEQ ID NO: 233053 - DNA, 24 bp, Artificial sequence
  SiRNA target sequence
tctacaaaataacgaaaactctgc

SEQ ID NO: 233054 - DNA, 24 bp, Artificial sequence
  SiRNA target sequence
ctacaaaataacgaaaactctgct

SEQ ID NO: 233055 - DNA, 24 bp, Artificial sequence
  SiRNA target sequence
tacaaaataacgaaaactctgctc

SEQ ID NO: 233056 - DNA, 24 bp, Artificial sequence
  SiRNA target sequence
acaaaataacgaaaactctgctct

SEQ ID NO: 233057 - DNA, 24 bp, Artificial sequence
  SiRNA target sequence
caaaataacgaaaactctgctctt

SEQ ID NO: 233058 - DNA, 24 bp, Artificial sequence
  SiRNA target sequence
aaaataacgaaaactctgctcttc

SEQ ID NO: 233059 - DNA, 24 bp, Artificial sequence
  SiRNA target sequence
aaataacgaaaactctgctcttcc

SEQ ID NO: 233060 - DNA, 24 bp, Artificial sequence
  SiRNA target sequence
aataacgaaaactctgctcttcct

SEQ ID NO: 233061 - DNA, 24 bp, Artificial sequence
  SiRNA target sequence
ataacgaaaactctgctcttccta

SEQ ID NO: 233062 - DNA, 24 bp, Artificial sequence
  SiRNA target sequence
taacgaaaactctgctcttcctac

SEQ ID NO: 233063 - DNA, 24 bp, Artificial sequence
  SiRNA target sequence
aacgaaaactctgctcttcctaca

SEQ ID NO: 233064 - DNA, 24 bp, Artificial sequence
  SiRNA target sequence
acgaaaactctgctcttcctacag

SEQ ID NO: 233065 - DNA, 24 bp, Artificial sequence
  SiRNA target sequence
cgaaaactctgctcttcctacaga

SEQ ID NO: 233066 - DNA, 24 bp, Artificial sequence
  SiRNA target sequence
gaaaactctgctcttcctacagaa

SEQ ID NO: 233067 - DNA, 24 bp, Artificial sequence
  SiRNA target sequence
aaaactctgctcttcctacagaag

SEQ ID NO: 233068 - DNA, 24 bp, Artificial sequence
  SiRNA target sequence
aaactctgctcttcctacagaaga

SEQ ID NO: 233069 - DNA, 24 bp, Artificial sequence
  SiRNA target sequence
aactctgctcttcctacagaagat

SEQ ID NO: 233070 - DNA, 24 bp, Artificial sequence
  SiRNA target sequence
actctgctcttcctacagaagatg

SEQ ID NO: 233071 - DNA, 24 bp, Artificial sequence
  SiRNA target sequence
ctctgctcttcctacagaagatga

SEQ ID NO: 233072 - DNA, 24 bp, Artificial sequence
  SiRNA target sequence
tctgctcttcctacagaagatgaa

SEQ ID NO: 233073 - DNA, 24 bp, Artificial sequence
  SiRNA target sequence
ctgctcttcctacagaagatgaaa

SEQ ID NO: 233074 - DNA, 24 bp, Artificial sequence
  SiRNA target sequence
tgctcttcctacagaagatgaaat

SEQ ID NO: 233075 - DNA, 24 bp, Artificial sequence
  SiRNA target sequence
gctcttcctacagaagatgaaatt

SEQ ID NO: 233076 - DNA, 24 bp, Artificial sequence
  SiRNA target sequence
ctcttcctacagaagatgaaattg

SEQ ID NO: 233077 - DNA, 24 bp, Artificial sequence
  SiRNA target sequence
tcttcctacagaagatgaaattga

SEQ ID NO: 233078 - DNA, 24 bp, Artificial sequence
  SiRNA target sequence
cttcctacagaagatgaaattgag

SEQ ID NO: 233079 - DNA, 24 bp, Artificial sequence
  SiRNA target sequence
ttcctacagaagatgaaattgagt

SEQ ID NO: 233080 - DNA, 24 bp, Artificial sequence
  SiRNA target sequence
tcctacagaagatgaaattgagta

SEQ ID NO: 233081 - DNA, 24 bp, Artificial sequence
  SiRNA target sequence
cctacagaagatgaaattgagtat

SEQ ID NO: 233082 - DNA, 24 bp, Artificial sequence
  SiRNA target sequence
ctacagaagatgaaattgagtatg

SEQ ID NO: 233083 - DNA, 24 bp, Artificial sequence
  SiRNA target sequence
tacagaagatgaaattgagtatga

SEQ ID NO: 233084 - DNA, 24 bp, Artificial sequence
  SiRNA target sequence
acagaagatgaaattgagtatgag

SEQ ID NO: 233085 - DNA, 24 bp, Artificial sequence
  SiRNA target sequence
cagaagatgaaattgagtatgagg

SEQ ID NO: 233086 - DNA, 24 bp, Artificial sequence
  SiRNA target sequence
agaagatgaaattgagtatgaggc

SEQ ID NO: 233087 - DNA, 24 bp, Artificial sequence
  SiRNA target sequence
gaagatgaaattgagtatgaggcc

SEQ ID NO: 233088 - DNA, 24 bp, Artificial sequence
  SiRNA target sequence
aagatgaaattgagtatgaggcca

SEQ ID NO: 233089 - DNA, 24 bp, Artificial sequence
  SiRNA target sequence
agatgaaattgagtatgaggccag

SEQ ID NO: 233090 - DNA, 24 bp, Artificial sequence
  SiRNA target sequence
gatgaaattgagtatgaggccagc

SEQ ID NO: 233091 - DNA, 24 bp, Artificial sequence
  SiRNA target sequence
atgaaattgagtatgaggccagca

SEQ ID NO: 233092 - DNA, 24 bp, Artificial sequence
  SiRNA target sequence
tgaaattgagtatgaggccagcaa

SEQ ID NO: 233093 - DNA, 24 bp, Artificial sequence
  SiRNA target sequence
gaaattgagtatgaggccagcaat

SEQ ID NO: 233094 - DNA, 24 bp, Artificial sequence
  SiRNA target sequence
aaattgagtatgaggccagcaatg

SEQ ID NO: 233095 - DNA, 24 bp, Artificial sequence
  SiRNA target sequence
aattgagtatgaggccagcaatgg

SEQ ID NO: 233096 - DNA, 24 bp, Artificial sequence
  SiRNA target sequence
attgagtatgaggccagcaatggt

SEQ ID NO: 233097 - DNA, 24 bp, Artificial sequence
  SiRNA target sequence
ttgagtatgaggccagcaatggtt

SEQ ID NO: 233098 - DNA, 24 bp, Artificial sequence
  SiRNA target sequence
tgagtatgaggccagcaatggttc

SEQ ID NO: 233099 - DNA, 24 bp, Artificial sequence
  SiRNA target sequence
gagtatgaggccagcaatggttct

SEQ ID NO: 233100 - DNA, 24 bp, Artificial sequence
  SiRNA target sequence
agtatgaggccagcaatggttctg

SEQ ID NO: 233101 - DNA, 24 bp, Artificial sequence
  SiRNA target sequence
gtatgaggccagcaatggttctgg

SEQ ID NO: 233102 - DNA, 24 bp, Artificial sequence
  SiRNA target sequence
tatgaggccagcaatggttctggt

SEQ ID NO: 233103 - DNA, 24 bp, Artificial sequence
  SiRNA target sequence
atgaggccagcaatggttctggta

SEQ ID NO: 233104 - DNA, 24 bp, Artificial sequence
  SiRNA target sequence
tgaggccagcaatggttctggtat

SEQ ID NO: 233105 - DNA, 24 bp, Artificial sequence
  SiRNA target sequence
gaggccagcaatggttctggtata

SEQ ID NO: 233106 - DNA, 24 bp, Artificial sequence
  SiRNA target sequence
aggccagcaatggttctggtatat

SEQ ID NO: 233107 - DNA, 24 bp, Artificial sequence
  SiRNA target sequence
ggccagcaatggttctggtatata

SEQ ID NO: 233108 - DNA, 24 bp, Artificial sequence
  SiRNA target sequence
gccagcaatggttctggtatatat

SEQ ID NO: 233109 - DNA, 24 bp, Artificial sequence
  SiRNA target sequence
ccagcaatggttctggtatatatt

SEQ ID NO: 233110 - DNA, 24 bp, Artificial sequence
  SiRNA target sequence
cagcaatggttctggtatatattc

SEQ ID NO: 233111 - DNA, 24 bp, Artificial sequence
  SiRNA target sequence
agcaatggttctggtatatattca

SEQ ID NO: 233112 - DNA, 24 bp, Artificial sequence
  SiRNA target sequence
gcaatggttctggtatatattcac

SEQ ID NO: 233113 - DNA, 24 bp, Artificial sequence
  SiRNA target sequence
caatggttctggtatatattcact

SEQ ID NO: 233114 - DNA, 24 bp, Artificial sequence
  SiRNA target sequence
aatggttctggtatatattcactt

SEQ ID NO: 233115 - DNA, 24 bp, Artificial sequence
  SiRNA target sequence
atggttctggtatatattcactta

SEQ ID NO: 233116 - DNA, 24 bp, Artificial sequence
  SiRNA target sequence
tggttctggtatatattcacttat

SEQ ID NO: 233117 - DNA, 24 bp, Artificial sequence
  SiRNA target sequence
ggttctggtatatattcacttatt

SEQ ID NO: 233118 - DNA, 24 bp, Artificial sequence
  SiRNA target sequence
gttctggtatatattcacttatta

SEQ ID NO: 233119 - DNA, 24 bp, Artificial sequence
  SiRNA target sequence
ttctggtatatattcacttattag

SEQ ID NO: 233120 - DNA, 24 bp, Artificial sequence
  SiRNA target sequence
tctggtatatattcacttattaga

SEQ ID NO: 233121 - DNA, 24 bp, Artificial sequence
  SiRNA target sequence
ctggtatatattcacttattagag

SEQ ID NO: 233122 - DNA, 24 bp, Artificial sequence
  SiRNA target sequence
tggtatatattcacttattagagt

SEQ ID NO: 233123 - DNA, 24 bp, Artificial sequence
  SiRNA target sequence
ggtatatattcacttattagagta

SEQ ID NO: 233124 - DNA, 24 bp, Artificial sequence
  SiRNA target sequence
gtatatattcacttattagagtag

SEQ ID NO: 233125 - DNA, 24 bp, Artificial sequence
  SiRNA target sequence
tatatattcacttattagagtagc

SEQ ID NO: 233126 - DNA, 24 bp, Artificial sequence
  SiRNA target sequence
atatattcacttattagagtagca

SEQ ID NO: 233127 - DNA, 24 bp, Artificial sequence
  SiRNA target sequence
tatattcacttattagagtagcaa

SEQ ID NO: 233128 - DNA, 24 bp, Artificial sequence
  SiRNA target sequence
atattcacttattagagtagcaaa

SEQ ID NO: 233129 - DNA, 24 bp, Artificial sequence
  SiRNA target sequence
tattcacttattagagtagcaaag

SEQ ID NO: 233130 - DNA, 24 bp, Artificial sequence
  SiRNA target sequence
attcacttattagagtagcaaagg

SEQ ID NO: 233131 - DNA, 24 bp, Artificial sequence
  SiRNA target sequence
ttcacttattagagtagcaaaggt

SEQ ID NO: 233132 - DNA, 24 bp, Artificial sequence
  SiRNA target sequence
tcacttattagagtagcaaaggtt

SEQ ID NO: 233133 - DNA, 24 bp, Artificial sequence
  SiRNA target sequence
cacttattagagtagcaaaggttg

SEQ ID NO: 233134 - DNA, 24 bp, Artificial sequence
  SiRNA target sequence
acttattagagtagcaaaggttga

SEQ ID NO: 233135 - DNA, 24 bp, Artificial sequence
  SiRNA target sequence
cttattagagtagcaaaggttgag

SEQ ID NO: 233136 - DNA, 24 bp, Artificial sequence
  SiRNA target sequence
ttattagagtagcaaaggttgaga

SEQ ID NO: 233137 - DNA, 24 bp, Artificial sequence
  SiRNA target sequence
tattagagtagcaaaggttgagag

SEQ ID NO: 233138 - DNA, 24 bp, Artificial sequence
  SiRNA target sequence
attagagtagcaaaggttgagaga

SEQ ID NO: 233139 - DNA, 24 bp, Artificial sequence
  SiRNA target sequence
ttagagtagcaaaggttgagagaa

SEQ ID NO: 233140 - DNA, 24 bp, Artificial sequence
  SiRNA target sequence
tagagtagcaaaggttgagagaaa

SEQ ID NO: 233141 - DNA, 24 bp, Artificial sequence
  SiRNA target sequence
agagtagcaaaggttgagagaaag

SEQ ID NO: 233142 - DNA, 24 bp, Artificial sequence
  SiRNA target sequence
gagtagcaaaggttgagagaaaga

SEQ ID NO: 233143 - DNA, 24 bp, Artificial sequence
  SiRNA target sequence
agtagcaaaggttgagagaaagat

SEQ ID NO: 233144 - DNA, 24 bp, Artificial sequence
  SiRNA target sequence
gtagcaaaggttgagagaaagatg

SEQ ID NO: 233145 - DNA, 24 bp, Artificial sequence
  SiRNA target sequence
tagcaaaggttgagagaaagatgt

SEQ ID NO: 233146 - DNA, 24 bp, Artificial sequence
  SiRNA target sequence
agcaaaggttgagagaaagatgtt

SEQ ID NO: 233147 - DNA, 24 bp, Artificial sequence
  SiRNA target sequence
gcaaaggttgagagaaagatgttt

SEQ ID NO: 233148 - DNA, 24 bp, Artificial sequence
  SiRNA target sequence
caaaggttgagagaaagatgtttt

SEQ ID NO: 233149 - DNA, 24 bp, Artificial sequence
  SiRNA target sequence
aaaggttgagagaaagatgttttg

SEQ ID NO: 233150 - DNA, 24 bp, Artificial sequence
  SiRNA target sequence
aaggttgagagaaagatgttttgg

SEQ ID NO: 233151 - DNA, 24 bp, Artificial sequence
  SiRNA target sequence
aggttgagagaaagatgttttgga

SEQ ID NO: 233152 - DNA, 24 bp, Artificial sequence
  SiRNA target sequence
ggttgagagaaagatgttttggat

SEQ ID NO: 233153 - DNA, 24 bp, Artificial sequence
  SiRNA target sequence
gttgagagaaagatgttttggatc

SEQ ID NO: 233154 - DNA, 24 bp, Artificial sequence
  SiRNA target sequence
ttgagagaaagatgttttggatca

SEQ ID NO: 233155 - DNA, 24 bp, Artificial sequence
  SiRNA target sequence
tgagagaaagatgttttggatcat

SEQ ID NO: 233156 - DNA, 24 bp, Artificial sequence
  SiRNA target sequence
gagagaaagatgttttggatcatg

SEQ ID NO: 233157 - DNA, 24 bp, Artificial sequence
  SiRNA target sequence
agagaaagatgttttggatcatgg

SEQ ID NO: 233158 - DNA, 24 bp, Artificial sequence
  SiRNA target sequence
gagaaagatgttttggatcatggc

SEQ ID NO: 233159 - DNA, 24 bp, Artificial sequence
  SiRNA target sequence
agaaagatgttttggatcatggca

SEQ ID NO: 233160 - DNA, 24 bp, Artificial sequence
  SiRNA target sequence
gaaagatgttttggatcatggcag

SEQ ID NO: 233161 - DNA, 24 bp, Artificial sequence
  SiRNA target sequence
aaagatgttttggatcatggcagc

SEQ ID NO: 233162 - DNA, 24 bp, Artificial sequence
  SiRNA target sequence
aagatgttttggatcatggcagct

SEQ ID NO: 233163 - DNA, 24 bp, Artificial sequence
  SiRNA target sequence
agatgttttggatcatggcagcta

SEQ ID NO: 233164 - DNA, 24 bp, Artificial sequence
  SiRNA target sequence
gatgttttggatcatggcagctat

SEQ ID NO: 233165 - DNA, 24 bp, Artificial sequence
  SiRNA target sequence
atgttttggatcatggcagctatg

SEQ ID NO: 233166 - DNA, 24 bp, Artificial sequence
  SiRNA target sequence
tgttttggatcatggcagctatgt

SEQ ID NO: 233167 - DNA, 24 bp, Artificial sequence
  SiRNA target sequence
gttttggatcatggcagctatgtt

SEQ ID NO: 233168 - DNA, 24 bp, Artificial sequence
  SiRNA target sequence
ttttggatcatggcagctatgttc

SEQ ID NO: 233169 - DNA, 24 bp, Artificial sequence
  SiRNA target sequence
tttggatcatggcagctatgttct

SEQ ID NO: 233170 - DNA, 24 bp, Artificial sequence
  SiRNA target sequence
ttggatcatggcagctatgttctt

SEQ ID NO: 233171 - DNA, 24 bp, Artificial sequence
  SiRNA target sequence
tggatcatggcagctatgttcttt

SEQ ID NO: 233172 - DNA, 24 bp, Artificial sequence
  SiRNA target sequence
ggatcatggcagctatgttcttta

SEQ ID NO: 233173 - DNA, 24 bp, Artificial sequence
  SiRNA target sequence
gatcatggcagctatgttctttat

SEQ ID NO: 233174 - DNA, 24 bp, Artificial sequence
  SiRNA target sequence
atcatggcagctatgttctttatt

SEQ ID NO: 233175 - DNA, 24 bp, Artificial sequence
  SiRNA target sequence
tcatggcagctatgttctttatta

SEQ ID NO: 233176 - DNA, 24 bp, Artificial sequence
  SiRNA target sequence
catggcagctatgttctttattat

SEQ ID NO: 233177 - DNA, 24 bp, Artificial sequence
  SiRNA target sequence
atggcagctatgttctttattatc

SEQ ID NO: 233178 - DNA, 24 bp, Artificial sequence
  SiRNA target sequence
tggcagctatgttctttattatct

SEQ ID NO: 233179 - DNA, 24 bp, Artificial sequence
  SiRNA target sequence
ggcagctatgttctttattatctc

SEQ ID NO: 233180 - DNA, 24 bp, Artificial sequence
  SiRNA target sequence
gcagctatgttctttattatctcc

SEQ ID NO: 233181 - DNA, 24 bp, Artificial sequence
  SiRNA target sequence
cagctatgttctttattatctcct

SEQ ID NO: 233182 - DNA, 24 bp, Artificial sequence
  SiRNA target sequence
agctatgttctttattatctcctt

SEQ ID NO: 233183 - DNA, 24 bp, Artificial sequence
  SiRNA target sequence
gctatgttctttattatctccttt

SEQ ID NO: 233184 - DNA, 24 bp, Artificial sequence
  SiRNA target sequence
ctatgttctttattatctccttta

SEQ ID NO: 233185 - DNA, 24 bp, Artificial sequence
  SiRNA target sequence
tatgttctttattatctcctttat

SEQ ID NO: 233186 - DNA, 24 bp, Artificial sequence
  SiRNA target sequence
atgttctttattatctcctttatt

SEQ ID NO: 233187 - DNA, 24 bp, Artificial sequence
  SiRNA target sequence
tgttctttattatctcctttattt

SEQ ID NO: 233188 - DNA, 24 bp, Artificial sequence
  SiRNA target sequence
gttctttattatctcctttattta

SEQ ID NO: 233189 - DNA, 24 bp, Artificial sequence
  SiRNA target sequence
ttctttattatctcctttatttat

SEQ ID NO: 233190 - DNA, 24 bp, Artificial sequence
  SiRNA target sequence
tctttattatctcctttatttatt

SEQ ID NO: 233191 - DNA, 24 bp, Artificial sequence
  SiRNA target sequence
ctttattatctcctttatttattc

SEQ ID NO: 233192 - DNA, 24 bp, Artificial sequence
  SiRNA target sequence
tttattatctcctttatttattcg

SEQ ID NO: 233193 - DNA, 24 bp, Artificial sequence
  SiRNA target sequence
ttattatctcctttatttattcgg

SEQ ID NO: 233194 - DNA, 24 bp, Artificial sequence
  SiRNA target sequence
tattatctcctttatttattcggt

SEQ ID NO: 233195 - DNA, 24 bp, Artificial sequence
  SiRNA target sequence
attatctcctttatttattcggtg

SEQ ID NO: 233196 - DNA, 24 bp, Artificial sequence
  SiRNA target sequence
ttatctcctttatttattcggtgg

SEQ ID NO: 233197 - DNA, 24 bp, Artificial sequence
  SiRNA target sequence
tatctcctttatttattcggtggc

SEQ ID NO: 233198 - DNA, 24 bp, Artificial sequence
  SiRNA target sequence
atctcctttatttattcggtggct

SEQ ID NO: 233199 - DNA, 24 bp, Artificial sequence
  SiRNA target sequence
tctcctttatttattcggtggcta

SEQ ID NO: 233200 - DNA, 24 bp, Artificial sequence
  SiRNA target sequence
ctcctttatttattcggtggctag

SEQ ID NO: 233201 - DNA, 24 bp, Artificial sequence
  SiRNA target sequence
tcctttatttattcggtggctaga

SEQ ID NO: 233202 - DNA, 24 bp, Artificial sequence
  SiRNA target sequence
cctttatttattcggtggctagag

SEQ ID NO: 233203 - DNA, 24 bp, Artificial sequence
  SiRNA target sequence
ctttatttattcggtggctagagt

SEQ ID NO: 233204 - DNA, 24 bp, Artificial sequence
  SiRNA target sequence
tttatttattcggtggctagagtg

SEQ ID NO: 233205 - DNA, 24 bp, Artificial sequence
  SiRNA target sequence
ttatttattcggtggctagagtgc

SEQ ID NO: 233206 - DNA, 24 bp, Artificial sequence
  SiRNA target sequence
tatttattcggtggctagagtgct

SEQ ID NO: 233207 - DNA, 24 bp, Artificial sequence
  SiRNA target sequence
atttattcggtggctagagtgctt

SEQ ID NO: 233208 - DNA, 24 bp, Artificial sequence
  SiRNA target sequence
tttattcggtggctagagtgctta

SEQ ID NO: 233209 - DNA, 24 bp, Artificial sequence
  SiRNA target sequence
ttattcggtggctagagtgcttaa

SEQ ID NO: 233210 - DNA, 24 bp, Artificial sequence
  SiRNA target sequence
tattcggtggctagagtgcttaaa

SEQ ID NO: 233211 - DNA, 24 bp, Artificial sequence
  SiRNA target sequence
attcggtggctagagtgcttaaag

SEQ ID NO: 233212 - DNA, 24 bp, Artificial sequence
  SiRNA target sequence
ttcggtggctagagtgcttaaaga

SEQ ID NO: 233213 - DNA, 24 bp, Artificial sequence
  SiRNA target sequence
tcggtggctagagtgcttaaagat

SEQ ID NO: 233214 - DNA, 24 bp, Artificial sequence
  SiRNA target sequence
cggtggctagagtgcttaaagatg

SEQ ID NO: 233215 - DNA, 24 bp, Artificial sequence
  SiRNA target sequence
ggtggctagagtgcttaaagatgc

SEQ ID NO: 233216 - DNA, 24 bp, Artificial sequence
  SiRNA target sequence
gtggctagagtgcttaaagatgcc

SEQ ID NO: 233217 - DNA, 24 bp, Artificial sequence
  SiRNA target sequence
tggctagagtgcttaaagatgccg

SEQ ID NO: 233218 - DNA, 24 bp, Artificial sequence
  SiRNA target sequence
ggctagagtgcttaaagatgccgc

SEQ ID NO: 233219 - DNA, 24 bp, Artificial sequence
  SiRNA target sequence
gctagagtgcttaaagatgccgct

SEQ ID NO: 233220 - DNA, 24 bp, Artificial sequence
  SiRNA target sequence
ctagagtgcttaaagatgccgctg

SEQ ID NO: 233221 - DNA, 24 bp, Artificial sequence
  SiRNA target sequence
tagagtgcttaaagatgccgctgt

SEQ ID NO: 233222 - DNA, 24 bp, Artificial sequence
  SiRNA target sequence
agagtgcttaaagatgccgctgtt

SEQ ID NO: 233223 - DNA, 24 bp, Artificial sequence
  SiRNA target sequence
gagtgcttaaagatgccgctgtta

SEQ ID NO: 233224 - DNA, 24 bp, Artificial sequence
  SiRNA target sequence
agtgcttaaagatgccgctgttat

SEQ ID NO: 233225 - DNA, 24 bp, Artificial sequence
  SiRNA target sequence
gtgcttaaagatgccgctgttatt

SEQ ID NO: 233226 - DNA, 24 bp, Artificial sequence
  SiRNA target sequence
tgcttaaagatgccgctgttattg

SEQ ID NO: 233227 - DNA, 24 bp, Artificial sequence
  SiRNA target sequence
gcttaaagatgccgctgttattgg

SEQ ID NO: 233228 - DNA, 24 bp, Artificial sequence
  SiRNA target sequence
cttaaagatgccgctgttattggt

SEQ ID NO: 233229 - DNA, 24 bp, Artificial sequence
  SiRNA target sequence
ttaaagatgccgctgttattggta

SEQ ID NO: 233230 - DNA, 24 bp, Artificial sequence
  SiRNA target sequence
taaagatgccgctgttattggtaa

SEQ ID NO: 233231 - DNA, 24 bp, Artificial sequence
  SiRNA target sequence
aaagatgccgctgttattggtaaa

SEQ ID NO: 233232 - DNA, 24 bp, Artificial sequence
  SiRNA target sequence
aagatgccgctgttattggtaaac

SEQ ID NO: 233233 - DNA, 24 bp, Artificial sequence
  SiRNA target sequence
agatgccgctgttattggtaaaca

SEQ ID NO: 233234 - DNA, 24 bp, Artificial sequence
  SiRNA target sequence
gatgccgctgttattggtaaacaa

SEQ ID NO: 233235 - DNA, 24 bp, Artificial sequence
  SiRNA target sequence
atgccgctgttattggtaaacaac

SEQ ID NO: 233236 - DNA, 24 bp, Artificial sequence
  SiRNA target sequence
tgccgctgttattggtaaacaact

SEQ ID NO: 233237 - DNA, 24 bp, Artificial sequence
  SiRNA target sequence
gccgctgttattggtaaacaactc

SEQ ID NO: 233238 - DNA, 24 bp, Artificial sequence
  SiRNA target sequence
ccgctgttattggtaaacaactcc

SEQ ID NO: 233239 - DNA, 24 bp, Artificial sequence
  SiRNA target sequence
cgctgttattggtaaacaactccc

SEQ ID NO: 233240 - DNA, 24 bp, Artificial sequence
  SiRNA target sequence
gctgttattggtaaacaactccca

SEQ ID NO: 233241 - DNA, 24 bp, Artificial sequence
  SiRNA target sequence
ctgttattggtaaacaactcccag

SEQ ID NO: 233242 - DNA, 24 bp, Artificial sequence
  SiRNA target sequence
tgttattggtaaacaactcccagc

SEQ ID NO: 233243 - DNA, 24 bp, Artificial sequence
  SiRNA target sequence
gttattggtaaacaactcccagcg

SEQ ID NO: 233244 - DNA, 24 bp, Artificial sequence
  SiRNA target sequence
ttattggtaaacaactcccagcgt

SEQ ID NO: 233245 - DNA, 24 bp, Artificial sequence
  SiRNA target sequence
tattggtaaacaactcccagcgtc

SEQ ID NO: 233246 - DNA, 24 bp, Artificial sequence
  SiRNA target sequence
attggtaaacaactcccagcgtca

SEQ ID NO: 233247 - DNA, 24 bp, Artificial sequence
  SiRNA target sequence
ttggtaaacaactcccagcgtcaa

SEQ ID NO: 233248 - DNA, 24 bp, Artificial sequence
  SiRNA target sequence
tggtaaacaactcccagcgtcaat

SEQ ID NO: 233249 - DNA, 24 bp, Artificial sequence
  SiRNA target sequence
ggtaaacaactcccagcgtcaatt

SEQ ID NO: 233250 - DNA, 24 bp, Artificial sequence
  SiRNA target sequence
gtaaacaactcccagcgtcaattt

SEQ ID NO: 233251 - DNA, 24 bp, Artificial sequence
  SiRNA target sequence
taaacaactcccagcgtcaatttt

SEQ ID NO: 233252 - DNA, 24 bp, Artificial sequence
  SiRNA target sequence
aaacaactcccagcgtcaattttc

SEQ ID NO: 233253 - DNA, 24 bp, Artificial sequence
  SiRNA target sequence
aacaactcccagcgtcaattttct

SEQ ID NO: 233254 - DNA, 24 bp, Artificial sequence
  SiRNA target sequence
acaactcccagcgtcaattttctt

SEQ ID NO: 233255 - DNA, 24 bp, Artificial sequence
  SiRNA target sequence
caactcccagcgtcaattttcttt

SEQ ID NO: 233256 - DNA, 24 bp, Artificial sequence
  SiRNA target sequence
aactcccagcgtcaattttctttt

SEQ ID NO: 233257 - DNA, 24 bp, Artificial sequence
  SiRNA target sequence
actcccagcgtcaattttcttttt

SEQ ID NO: 233258 - DNA, 24 bp, Artificial sequence
  SiRNA target sequence
ctcccagcgtcaattttctttttg

SEQ ID NO: 233259 - DNA, 24 bp, Artificial sequence
  SiRNA target sequence
tcccagcgtcaattttctttttga

SEQ ID NO: 233260 - DNA, 24 bp, Artificial sequence
  SiRNA target sequence
cccagcgtcaattttctttttgaa

SEQ ID NO: 233261 - DNA, 24 bp, Artificial sequence
  SiRNA target sequence
ccagcgtcaattttctttttgaaa

SEQ ID NO: 233262 - DNA, 24 bp, Artificial sequence
  SiRNA target sequence
cagcgtcaattttctttttgaaat

SEQ ID NO: 233263 - DNA, 24 bp, Artificial sequence
  SiRNA target sequence
agcgtcaattttctttttgaaatt

SEQ ID NO: 233264 - DNA, 24 bp, Artificial sequence
  SiRNA target sequence
gcgtcaattttctttttgaaattt

SEQ ID NO: 233265 - DNA, 24 bp, Artificial sequence
  SiRNA target sequence
cgtcaattttctttttgaaatttg

SEQ ID NO: 233266 - DNA, 24 bp, Artificial sequence
  SiRNA target sequence
gtcaattttctttttgaaatttgt

SEQ ID NO: 233267 - DNA, 24 bp, Artificial sequence
  SiRNA target sequence
tcaattttctttttgaaatttgtt

SEQ ID NO: 233268 - DNA, 24 bp, Artificial sequence
  SiRNA target sequence
caattttctttttgaaatttgtta

SEQ ID NO: 233269 - DNA, 24 bp, Artificial sequence
  SiRNA target sequence
aattttctttttgaaatttgttat

SEQ ID NO: 233270 - DNA, 24 bp, Artificial sequence
  SiRNA target sequence
attttctttttgaaatttgttatt

SEQ ID NO: 233271 - DNA, 24 bp, Artificial sequence
  SiRNA target sequence
ttttctttttgaaatttgttatta

SEQ ID NO: 233272 - DNA, 24 bp, Artificial sequence
  SiRNA target sequence
tttctttttgaaatttgttattat

SEQ ID NO: 233273 - DNA, 24 bp, Artificial sequence
  SiRNA target sequence
ttctttttgaaatttgttattatc

SEQ ID NO: 233274 - DNA, 24 bp, Artificial sequence
  SiRNA target sequence
tctttttgaaatttgttattatcc

SEQ ID NO: 233275 - DNA, 24 bp, Artificial sequence
  SiRNA target sequence
ctttttgaaatttgttattatcct

SEQ ID NO: 233276 - DNA, 24 bp, Artificial sequence
  SiRNA target sequence
tttttgaaatttgttattatcctt

SEQ ID NO: 233277 - DNA, 24 bp, Artificial sequence
  SiRNA target sequence
ttttgaaatttgttattatccttc

SEQ ID NO: 233278 - DNA, 24 bp, Artificial sequence
  SiRNA target sequence
tttgaaatttgttattatccttcc

SEQ ID NO: 233279 - DNA, 24 bp, Artificial sequence
  SiRNA target sequence
ttgaaatttgttattatccttccg

SEQ ID NO: 233280 - DNA, 24 bp, Artificial sequence
  SiRNA target sequence
tgaaatttgttattatccttccgt

SEQ ID NO: 233281 - DNA, 24 bp, Artificial sequence
  SiRNA target sequence
gaaatttgttattatccttccgtt

SEQ ID NO: 233282 - DNA, 24 bp, Artificial sequence
  SiRNA target sequence
aaatttgttattatccttccgttc

SEQ ID NO: 233283 - DNA, 24 bp, Artificial sequence
  SiRNA target sequence
aatttgttattatccttccgttct

SEQ ID NO: 233284 - DNA, 24 bp, Artificial sequence
  SiRNA target sequence
atttgttattatccttccgttctc

SEQ ID NO: 233285 - DNA, 24 bp, Artificial sequence
  SiRNA target sequence
tttgttattatccttccgttctca

SEQ ID NO: 233286 - DNA, 24 bp, Artificial sequence
  SiRNA target sequence
ttgttattatccttccgttctcat

SEQ ID NO: 233287 - DNA, 24 bp, Artificial sequence
  SiRNA target sequence
tgttattatccttccgttctcatt

SEQ ID NO: 233288 - DNA, 24 bp, Artificial sequence
  SiRNA target sequence
gttattatccttccgttctcattt

SEQ ID NO: 233289 - DNA, 24 bp, Artificial sequence
  SiRNA target sequence
ttattatccttccgttctcattta

SEQ ID NO: 233290 - DNA, 24 bp, Artificial sequence
  SiRNA target sequence
tattatccttccgttctcatttat

SEQ ID NO: 233291 - DNA, 24 bp, Artificial sequence
  SiRNA target sequence
attatccttccgttctcatttatt

SEQ ID NO: 233292 - DNA, 24 bp, Artificial sequence
  SiRNA target sequence
ttatccttccgttctcatttattt

SEQ ID NO: 233293 - DNA, 24 bp, Artificial sequence
  SiRNA target sequence
tatccttccgttctcatttatttc

SEQ ID NO: 233294 - DNA, 24 bp, Artificial sequence
  SiRNA target sequence
atccttccgttctcatttatttca

SEQ ID NO: 233295 - DNA, 24 bp, Artificial sequence
  SiRNA target sequence
tccttccgttctcatttatttcag

SEQ ID NO: 233296 - DNA, 24 bp, Artificial sequence
  SiRNA target sequence
ccttccgttctcatttatttcagt

SEQ ID NO: 233297 - DNA, 24 bp, Artificial sequence
  SiRNA target sequence
cttccgttctcatttatttcagta

SEQ ID NO: 233298 - DNA, 24 bp, Artificial sequence
  SiRNA target sequence
ttccgttctcatttatttcagtag

SEQ ID NO: 233299 - DNA, 24 bp, Artificial sequence
  SiRNA target sequence
tccgttctcatttatttcagtagg

SEQ ID NO: 233300 - DNA, 24 bp, Artificial sequence
  SiRNA target sequence
ccgttctcatttatttcagtaggt

SEQ ID NO: 233301 - DNA, 24 bp, Artificial sequence
  SiRNA target sequence
cgttctcatttatttcagtaggta

SEQ ID NO: 233302 - DNA, 24 bp, Artificial sequence
  SiRNA target sequence
gttctcatttatttcagtaggtat

SEQ ID NO: 233303 - DNA, 24 bp, Artificial sequence
  SiRNA target sequence
ttctcatttatttcagtaggtatt

SEQ ID NO: 233304 - DNA, 24 bp, Artificial sequence
  SiRNA target sequence
tctcatttatttcagtaggtatta

SEQ ID NO: 233305 - DNA, 24 bp, Artificial sequence
  SiRNA target sequence
ctcatttatttcagtaggtattat

SEQ ID NO: 233306 - DNA, 24 bp, Artificial sequence
  SiRNA target sequence
tcatttatttcagtaggtattatt

SEQ ID NO: 233307 - DNA, 24 bp, Artificial sequence
  SiRNA target sequence
catttatttcagtaggtattattc

SEQ ID NO: 233308 - DNA, 24 bp, Artificial sequence
  SiRNA target sequence
atttatttcagtaggtattattca

SEQ ID NO: 233309 - DNA, 24 bp, Artificial sequence
  SiRNA target sequence
tttatttcagtaggtattattcag

SEQ ID NO: 233310 - DNA, 24 bp, Artificial sequence
  SiRNA target sequence
ttatttcagtaggtattattcaga

SEQ ID NO: 233311 - DNA, 24 bp, Artificial sequence
  SiRNA target sequence
tatttcagtaggtattattcagaa

SEQ ID NO: 233312 - DNA, 24 bp, Artificial sequence
  SiRNA target sequence
atttcagtaggtattattcagaaa

SEQ ID NO: 233313 - DNA, 24 bp, Artificial sequence
  SiRNA target sequence
tttcagtaggtattattcagaaag

SEQ ID NO: 233314 - DNA, 24 bp, Artificial sequence
  SiRNA target sequence
ttcagtaggtattattcagaaagc

SEQ ID NO: 233315 - DNA, 24 bp, Artificial sequence
  SiRNA target sequence
tcagtaggtattattcagaaagct

SEQ ID NO: 233316 - DNA, 24 bp, Artificial sequence
  SiRNA target sequence
cagtaggtattattcagaaagctt

SEQ ID NO: 233317 - DNA, 24 bp, Artificial sequence
  SiRNA target sequence
agtaggtattattcagaaagcttt

SEQ ID NO: 233318 - DNA, 24 bp, Artificial sequence
  SiRNA target sequence
gtaggtattattcagaaagcttta

SEQ ID NO: 233319 - DNA, 24 bp, Artificial sequence
  SiRNA target sequence
taggtattattcagaaagctttag

SEQ ID NO: 233320 - DNA, 24 bp, Artificial sequence
  SiRNA target sequence
aggtattattcagaaagctttaga

SEQ ID NO: 233321 - DNA, 24 bp, Artificial sequence
  SiRNA target sequence
ggtattattcagaaagctttagat

SEQ ID NO: 233322 - DNA, 24 bp, Artificial sequence
  SiRNA target sequence
gtattattcagaaagctttagata

SEQ ID NO: 233323 - DNA, 24 bp, Artificial sequence
  SiRNA target sequence
tattattcagaaagctttagataa

SEQ ID NO: 233324 - DNA, 24 bp, Artificial sequence
  SiRNA target sequence
attattcagaaagctttagataaa

SEQ ID NO: 233325 - DNA, 24 bp, Artificial sequence
  SiRNA target sequence
ttattcagaaagctttagataaat

SEQ ID NO: 233326 - DNA, 24 bp, Artificial sequence
  SiRNA target sequence
tattcagaaagctttagataaata

SEQ ID NO: 233327 - DNA, 24 bp, Artificial sequence
  SiRNA target sequence
attcagaaagctttagataaatat

SEQ ID NO: 233328 - DNA, 24 bp, Artificial sequence
  SiRNA target sequence
ttcagaaagctttagataaatatc

SEQ ID NO: 233329 - DNA, 24 bp, Artificial sequence
  SiRNA target sequence
tcagaaagctttagataaatatcc

SEQ ID NO: 233330 - DNA, 24 bp, Artificial sequence
  SiRNA target sequence
cagaaagctttagataaatatcct

SEQ ID NO: 233331 - DNA, 24 bp, Artificial sequence
  SiRNA target sequence
agaaagctttagataaatatcctt

SEQ ID NO: 233332 - DNA, 24 bp, Artificial sequence
  SiRNA target sequence
gaaagctttagataaatatccttt

SEQ ID NO: 233333 - DNA, 24 bp, Artificial sequence
  SiRNA target sequence
aaagctttagataaatatcctttt

SEQ ID NO: 233334 - DNA, 24 bp, Artificial sequence
  SiRNA target sequence
aagctttagataaatatcctttta

SEQ ID NO: 233335 - DNA, 24 bp, Artificial sequence
  SiRNA target sequence
agctttagataaatatccttttac

SEQ ID NO: 233336 - DNA, 24 bp, Artificial sequence
  SiRNA target sequence
gctttagataaatatccttttaca

SEQ ID NO: 233337 - DNA, 24 bp, Artificial sequence
  SiRNA target sequence
ctttagataaatatccttttacaa

SEQ ID NO: 233338 - DNA, 24 bp, Artificial sequence
  SiRNA target sequence
tttagataaatatccttttacaaa

SEQ ID NO: 233339 - DNA, 24 bp, Artificial sequence
  SiRNA target sequence
ttagataaatatccttttacaaaa

SEQ ID NO: 233340 - DNA, 24 bp, Artificial sequence
  SiRNA target sequence
tagataaatatccttttacaaaaa

SEQ ID NO: 233341 - DNA, 24 bp, Artificial sequence
  SiRNA target sequence
agataaatatccttttacaaaaat

SEQ ID NO: 233342 - DNA, 24 bp, Artificial sequence
  SiRNA target sequence
gataaatatccttttacaaaaata

SEQ ID NO: 233343 - DNA, 24 bp, Artificial sequence
  SiRNA target sequence
ataaatatccttttacaaaaatat

SEQ ID NO: 233344 - DNA, 24 bp, Artificial sequence
  SiRNA target sequence
taaatatccttttacaaaaatatt

SEQ ID NO: 233345 - DNA, 24 bp, Artificial sequence
  SiRNA target sequence
aaatatccttttacaaaaatattt

SEQ ID NO: 233346 - DNA, 24 bp, Artificial sequence
  SiRNA target sequence
aatatccttttacaaaaatatttg

SEQ ID NO: 233347 - DNA, 24 bp, Artificial sequence
  SiRNA target sequence
atatccttttacaaaaatatttga

SEQ ID NO: 233348 - DNA, 24 bp, Artificial sequence
  SiRNA target sequence
tatccttttacaaaaatatttgat

SEQ ID NO: 233349 - DNA, 24 bp, Artificial sequence
  SiRNA target sequence
atccttttacaaaaatatttgatg

SEQ ID NO: 233350 - DNA, 24 bp, Artificial sequence
  SiRNA target sequence
tccttttacaaaaatatttgatgt

SEQ ID NO: 233351 - DNA, 24 bp, Artificial sequence
  SiRNA target sequence
ccttttacaaaaatatttgatgta

SEQ ID NO: 233352 - DNA, 24 bp, Artificial sequence
  SiRNA target sequence
cttttacaaaaatatttgatgtaa

SEQ ID NO: 233353 - DNA, 24 bp, Artificial sequence
  SiRNA target sequence
ttttacaaaaatatttgatgtaac

SEQ ID NO: 233354 - DNA, 24 bp, Artificial sequence
  SiRNA target sequence
tttacaaaaatatttgatgtaact

SEQ ID NO: 233355 - DNA, 24 bp, Artificial sequence
  SiRNA target sequence
ttacaaaaatatttgatgtaactt

SEQ ID NO: 233356 - DNA, 24 bp, Artificial sequence
  SiRNA target sequence
tacaaaaatatttgatgtaacttt

SEQ ID NO: 233357 - DNA, 24 bp, Artificial sequence
  SiRNA target sequence
acaaaaatatttgatgtaacttta

SEQ ID NO: 233358 - DNA, 24 bp, Artificial sequence
  SiRNA target sequence
caaaaatatttgatgtaactttaa

SEQ ID NO: 233359 - DNA, 24 bp, Artificial sequence
  SiRNA target sequence
aaaaatatttgatgtaactttaat

SEQ ID NO: 233360 - DNA, 24 bp, Artificial sequence
  SiRNA target sequence
aaaatatttgatgtaactttaata

SEQ ID NO: 233361 - DNA, 24 bp, Artificial sequence
  SiRNA target sequence
aaatatttgatgtaactttaatag

SEQ ID NO: 233362 - DNA, 24 bp, Artificial sequence
  SiRNA target sequence
aatatttgatgtaactttaatagt

SEQ ID NO: 233363 - DNA, 24 bp, Artificial sequence
  SiRNA target sequence
atatttgatgtaactttaatagtt

SEQ ID NO: 233364 - DNA, 24 bp, Artificial sequence
  SiRNA target sequence
tatttgatgtaactttaatagttt

SEQ ID NO: 233365 - DNA, 24 bp, Artificial sequence
  SiRNA target sequence
atttgatgtaactttaatagtttt

SEQ ID NO: 233366 - DNA, 24 bp, Artificial sequence
  SiRNA target sequence
tttgatgtaactttaatagttttc

SEQ ID NO: 233367 - DNA, 24 bp, Artificial sequence
  SiRNA target sequence
ttgatgtaactttaatagttttcg

SEQ ID NO: 233368 - DNA, 24 bp, Artificial sequence
  SiRNA target sequence
tgatgtaactttaatagttttcgc

SEQ ID NO: 233369 - DNA, 24 bp, Artificial sequence
  SiRNA target sequence
gatgtaactttaatagttttcgct

SEQ ID NO: 233370 - DNA, 24 bp, Artificial sequence
  SiRNA target sequence
atgtaactttaatagttttcgctg

SEQ ID NO: 233371 - DNA, 24 bp, Artificial sequence
  SiRNA target sequence
tgtaactttaatagttttcgctgt

SEQ ID NO: 233372 - DNA, 24 bp, Artificial sequence
  SiRNA target sequence
gtaactttaatagttttcgctgtt

SEQ ID NO: 233373 - DNA, 24 bp, Artificial sequence
  SiRNA target sequence
taactttaatagttttcgctgttg

SEQ ID NO: 233374 - DNA, 24 bp, Artificial sequence
  SiRNA target sequence
aactttaatagttttcgctgttgc

SEQ ID NO: 233375 - DNA, 24 bp, Artificial sequence
  SiRNA target sequence
actttaatagttttcgctgttgca

SEQ ID NO: 233376 - DNA, 24 bp, Artificial sequence
  SiRNA target sequence
ctttaatagttttcgctgttgcat

SEQ ID NO: 233377 - DNA, 24 bp, Artificial sequence
  SiRNA target sequence
tttaatagttttcgctgttgcatt

SEQ ID NO: 233378 - DNA, 24 bp, Artificial sequence
  SiRNA target sequence
ttaatagttttcgctgttgcattt

SEQ ID NO: 233379 - DNA, 24 bp, Artificial sequence
  SiRNA target sequence
taatagttttcgctgttgcattta

SEQ ID NO: 233380 - DNA, 24 bp, Artificial sequence
  SiRNA target sequence
aatagttttcgctgttgcatttac

SEQ ID NO: 233381 - DNA, 24 bp, Artificial sequence
  SiRNA target sequence
atagttttcgctgttgcatttact

SEQ ID NO: 233382 - DNA, 24 bp, Artificial sequence
  SiRNA target sequence
tagttttcgctgttgcatttacta

SEQ ID NO: 233383 - DNA, 24 bp, Artificial sequence
  SiRNA target sequence
agttttcgctgttgcatttactat

SEQ ID NO: 233384 - DNA, 24 bp, Artificial sequence
  SiRNA target sequence
gttttcgctgttgcatttactata

SEQ ID NO: 233385 - DNA, 24 bp, Artificial sequence
  SiRNA target sequence
ttttcgctgttgcatttactatac

SEQ ID NO: 233386 - DNA, 24 bp, Artificial sequence
  SiRNA target sequence
tttcgctgttgcatttactatact

SEQ ID NO: 233387 - DNA, 24 bp, Artificial sequence
  SiRNA target sequence
ttcgctgttgcatttactatactt

SEQ ID NO: 233388 - DNA, 24 bp, Artificial sequence
  SiRNA target sequence
tcgctgttgcatttactatacttg

SEQ ID NO: 233389 - DNA, 24 bp, Artificial sequence
  SiRNA target sequence
cgctgttgcatttactatacttgg

SEQ ID NO: 233390 - DNA, 24 bp, Artificial sequence
  SiRNA target sequence
gctgttgcatttactatacttggt

SEQ ID NO: 233391 - DNA, 24 bp, Artificial sequence
  SiRNA target sequence
ctgttgcatttactatacttggta

SEQ ID NO: 233392 - DNA, 24 bp, Artificial sequence
  SiRNA target sequence
tgttgcatttactatacttggtag

SEQ ID NO: 233393 - DNA, 24 bp, Artificial sequence
  SiRNA target sequence
gttgcatttactatacttggtagt

SEQ ID NO: 233394 - DNA, 24 bp, Artificial sequence
  SiRNA target sequence
ttgcatttactatacttggtagtt

SEQ ID NO: 233395 - DNA, 24 bp, Artificial sequence
  SiRNA target sequence
tgcatttactatacttggtagttt

SEQ ID NO: 233396 - DNA, 24 bp, Artificial sequence
  SiRNA target sequence
gcatttactatacttggtagttta

SEQ ID NO: 233397 - DNA, 24 bp, Artificial sequence
  SiRNA target sequence
catttactatacttggtagtttat

SEQ ID NO: 233398 - DNA, 24 bp, Artificial sequence
  SiRNA target sequence
atttactatacttggtagtttatt

SEQ ID NO: 233399 - DNA, 24 bp, Artificial sequence
  SiRNA target sequence
tttactatacttggtagtttatta

SEQ ID NO: 233400 - DNA, 24 bp, Artificial sequence
  SiRNA target sequence
ttactatacttggtagtttattac

SEQ ID NO: 233401 - DNA, 24 bp, Artificial sequence
  SiRNA target sequence
tactatacttggtagtttattact

SEQ ID NO: 233402 - DNA, 24 bp, Artificial sequence
  SiRNA target sequence
actatacttggtagtttattactt

SEQ ID NO: 233403 - DNA, 24 bp, Artificial sequence
  SiRNA target sequence
ctatacttggtagtttattacttc

SEQ ID NO: 233404 - DNA, 24 bp, Artificial sequence
  SiRNA target sequence
tatacttggtagtttattacttcc

SEQ ID NO: 233405 - DNA, 24 bp, Artificial sequence
  SiRNA target sequence
atacttggtagtttattacttccc

SEQ ID NO: 233406 - DNA, 24 bp, Artificial sequence
  SiRNA target sequence
tacttggtagtttattacttccct

SEQ ID NO: 233407 - DNA, 24 bp, Artificial sequence
  SiRNA target sequence
acttggtagtttattacttccctt

SEQ ID NO: 233408 - DNA, 24 bp, Artificial sequence
  SiRNA target sequence
cttggtagtttattacttcccttt

SEQ ID NO: 233409 - DNA, 24 bp, Artificial sequence
  SiRNA target sequence
ttggtagtttattacttcccttta

SEQ ID NO: 233410 - DNA, 24 bp, Artificial sequence
  SiRNA target sequence
tggtagtttattacttccctttag

SEQ ID NO: 233411 - DNA, 24 bp, Artificial sequence
  SiRNA target sequence
ggtagtttattacttccctttagt

SEQ ID NO: 233412 - DNA, 24 bp, Artificial sequence
  SiRNA target sequence
gtagtttattacttccctttagtg

SEQ ID NO: 233413 - DNA, 24 bp, Artificial sequence
  SiRNA target sequence
tagtttattacttccctttagtga

SEQ ID NO: 233414 - DNA, 24 bp, Artificial sequence
  SiRNA target sequence
agtttattacttccctttagtgat

SEQ ID NO: 233415 - DNA, 24 bp, Artificial sequence
  SiRNA target sequence
gtttattacttccctttagtgatt

SEQ ID NO: 233416 - DNA, 24 bp, Artificial sequence
  SiRNA target sequence
tttattacttccctttagtgatta

SEQ ID NO: 233417 - DNA, 24 bp, Artificial sequence
  SiRNA target sequence
ttattacttccctttagtgattat

SEQ ID NO: 233418 - DNA, 24 bp, Artificial sequence
  SiRNA target sequence
tattacttccctttagtgattata

SEQ ID NO: 233419 - DNA, 24 bp, Artificial sequence
  SiRNA target sequence
attacttccctttagtgattatat

SEQ ID NO: 233420 - DNA, 24 bp, Artificial sequence
  SiRNA target sequence
ttacttccctttagtgattatatt

SEQ ID NO: 233421 - DNA, 24 bp, Artificial sequence
  SiRNA target sequence
tacttccctttagtgattatattc

SEQ ID NO: 233422 - DNA, 24 bp, Artificial sequence
  SiRNA target sequence
acttccctttagtgattatattca

SEQ ID NO: 233423 - DNA, 24 bp, Artificial sequence
  SiRNA target sequence
cttccctttagtgattatattcag

SEQ ID NO: 233424 - DNA, 24 bp, Artificial sequence
  SiRNA target sequence
ttccctttagtgattatattcaga

SEQ ID NO: 233425 - DNA, 24 bp, Artificial sequence
  SiRNA target sequence
tccctttagtgattatattcagat

SEQ ID NO: 233426 - DNA, 24 bp, Artificial sequence
  SiRNA target sequence
ccctttagtgattatattcagatt

SEQ ID NO: 233427 - DNA, 24 bp, Artificial sequence
  SiRNA target sequence
cctttagtgattatattcagattc

SEQ ID NO: 233428 - DNA, 24 bp, Artificial sequence
  SiRNA target sequence
ctttagtgattatattcagattca

SEQ ID NO: 233429 - DNA, 24 bp, Artificial sequence
  SiRNA target sequence
tttagtgattatattcagattcaa

SEQ ID NO: 233430 - DNA, 24 bp, Artificial sequence
  SiRNA target sequence
ttagtgattatattcagattcaac

SEQ ID NO: 233431 - DNA, 24 bp, Artificial sequence
  SiRNA target sequence
tagtgattatattcagattcaacc

SEQ ID NO: 233432 - DNA, 24 bp, Artificial sequence
  SiRNA target sequence
agtgattatattcagattcaaccg

SEQ ID NO: 233433 - DNA, 24 bp, Artificial sequence
  SiRNA target sequence
gtgattatattcagattcaaccgt

SEQ ID NO: 233434 - DNA, 24 bp, Artificial sequence
  SiRNA target sequence
tgattatattcagattcaaccgtt

SEQ ID NO: 233435 - DNA, 24 bp, Artificial sequence
  SiRNA target sequence
gattatattcagattcaaccgttt

SEQ ID NO: 233436 - DNA, 24 bp, Artificial sequence
  SiRNA target sequence
attatattcagattcaaccgtttt

SEQ ID NO: 233437 - DNA, 24 bp, Artificial sequence
  SiRNA target sequence
ttatattcagattcaaccgttttg

SEQ ID NO: 233438 - DNA, 24 bp, Artificial sequence
  SiRNA target sequence
tatattcagattcaaccgttttgg

SEQ ID NO: 233439 - DNA, 24 bp, Artificial sequence
  SiRNA target sequence
atattcagattcaaccgttttggg

SEQ ID NO: 233440 - DNA, 24 bp, Artificial sequence
  SiRNA target sequence
tattcagattcaaccgttttgggc

SEQ ID NO: 233441 - DNA, 24 bp, Artificial sequence
  SiRNA target sequence
attcagattcaaccgttttgggcc

SEQ ID NO: 233442 - DNA, 24 bp, Artificial sequence
  SiRNA target sequence
ttcagattcaaccgttttgggcca

SEQ ID NO: 233443 - DNA, 24 bp, Artificial sequence
  SiRNA target sequence
tcagattcaaccgttttgggccaa

SEQ ID NO: 233444 - DNA, 24 bp, Artificial sequence
  SiRNA target sequence
cagattcaaccgttttgggccaaa

SEQ ID NO: 233445 - DNA, 24 bp, Artificial sequence
  SiRNA target sequence
agattcaaccgttttgggccaaag

SEQ ID NO: 233446 - DNA, 24 bp, Artificial sequence
  SiRNA target sequence
gattcaaccgttttgggccaaaga

SEQ ID NO: 233447 - DNA, 24 bp, Artificial sequence
  SiRNA target sequence
attcaaccgttttgggccaaagat

SEQ ID NO: 233448 - DNA, 24 bp, Artificial sequence
  SiRNA target sequence
ttcaaccgttttgggccaaagata

SEQ ID NO: 233449 - DNA, 24 bp, Artificial sequence
  SiRNA target sequence
tcaaccgttttgggccaaagatat

SEQ ID NO: 233450 - DNA, 24 bp, Artificial sequence
  SiRNA target sequence
caaccgttttgggccaaagatatt

SEQ ID NO: 233451 - DNA, 24 bp, Artificial sequence
  SiRNA target sequence
aaccgttttgggccaaagatattt

SEQ ID NO: 233452 - DNA, 24 bp, Artificial sequence
  SiRNA target sequence
accgttttgggccaaagatatttt

SEQ ID NO: 233453 - DNA, 24 bp, Artificial sequence
  SiRNA target sequence
ccgttttgggccaaagatattttt

SEQ ID NO: 233454 - DNA, 24 bp, Artificial sequence
  SiRNA target sequence
cgttttgggccaaagatatttttg

SEQ ID NO: 233455 - DNA, 24 bp, Artificial sequence
  SiRNA target sequence
gttttgggccaaagatatttttgc

SEQ ID NO: 233456 - DNA, 24 bp, Artificial sequence
  SiRNA target sequence
ttttgggccaaagatatttttgct

SEQ ID NO: 233457 - DNA, 24 bp, Artificial sequence
  SiRNA target sequence
tttgggccaaagatatttttgctg

SEQ ID NO: 233458 - DNA, 24 bp, Artificial sequence
  SiRNA target sequence
ttgggccaaagatatttttgctga

SEQ ID NO: 233459 - DNA, 24 bp, Artificial sequence
  SiRNA target sequence
tgggccaaagatatttttgctgat

SEQ ID NO: 233460 - DNA, 24 bp, Artificial sequence
  SiRNA target sequence
gggccaaagatatttttgctgatg

SEQ ID NO: 233461 - DNA, 24 bp, Artificial sequence
  SiRNA target sequence
ggccaaagatatttttgctgatgg

SEQ ID NO: 233462 - DNA, 24 bp, Artificial sequence
  SiRNA target sequence
gccaaagatatttttgctgatgga

SEQ ID NO: 233463 - DNA, 24 bp, Artificial sequence
  SiRNA target sequence
ccaaagatatttttgctgatggaa

SEQ ID NO: 233464 - DNA, 24 bp, Artificial sequence
  SiRNA target sequence
caaagatatttttgctgatggaaa

SEQ ID NO: 233465 - DNA, 24 bp, Artificial sequence
  SiRNA target sequence
aaagatatttttgctgatggaaaa

SEQ ID NO: 233466 - DNA, 24 bp, Artificial sequence
  SiRNA target sequence
aagatatttttgctgatggaaaag

SEQ ID NO: 233467 - DNA, 24 bp, Artificial sequence
  SiRNA target sequence
agatatttttgctgatggaaaagc

SEQ ID NO: 233468 - DNA, 24 bp, Artificial sequence
  SiRNA target sequence
gatatttttgctgatggaaaagct

SEQ ID NO: 233469 - DNA, 24 bp, Artificial sequence
  SiRNA target sequence
atatttttgctgatggaaaagctg

SEQ ID NO: 233470 - DNA, 24 bp, Artificial sequence
  SiRNA target sequence
tatttttgctgatggaaaagctgt

SEQ ID NO: 233471 - DNA, 24 bp, Artificial sequence
  SiRNA target sequence
atttttgctgatggaaaagctgtt

SEQ ID NO: 233472 - DNA, 24 bp, Artificial sequence
  SiRNA target sequence
tttttgctgatggaaaagctgttg

SEQ ID NO: 233473 - DNA, 24 bp, Artificial sequence
  SiRNA target sequence
ttttgctgatggaaaagctgttgc

SEQ ID NO: 233474 - DNA, 24 bp, Artificial sequence
  SiRNA target sequence
tttgctgatggaaaagctgttgcc

SEQ ID NO: 233475 - DNA, 24 bp, Artificial sequence
  SiRNA target sequence
ttgctgatggaaaagctgttgcca

SEQ ID NO: 233476 - DNA, 24 bp, Artificial sequence
  SiRNA target sequence
tgctgatggaaaagctgttgccag

SEQ ID NO: 233477 - DNA, 24 bp, Artificial sequence
  SiRNA target sequence
gctgatggaaaagctgttgccaga

SEQ ID NO: 233478 - DNA, 24 bp, Artificial sequence
  SiRNA target sequence
ctgatggaaaagctgttgccagaa

SEQ ID NO: 233479 - DNA, 24 bp, Artificial sequence
  SiRNA target sequence
tgatggaaaagctgttgccagaag

SEQ ID NO: 233480 - DNA, 24 bp, Artificial sequence
  SiRNA target sequence
gatggaaaagctgttgccagaagt

SEQ ID NO: 233481 - DNA, 24 bp, Artificial sequence
  SiRNA target sequence
atggaaaagctgttgccagaagta

SEQ ID NO: 233482 - DNA, 24 bp, Artificial sequence
  SiRNA target sequence
tggaaaagctgttgccagaagtac

SEQ ID NO: 233483 - DNA, 24 bp, Artificial sequence
  SiRNA target sequence
ggaaaagctgttgccagaagtaca

SEQ ID NO: 233484 - DNA, 24 bp, Artificial sequence
  SiRNA target sequence
gaaaagctgttgccagaagtacag

SEQ ID NO: 233485 - DNA, 24 bp, Artificial sequence
  SiRNA target sequence
aaaagctgttgccagaagtacaga

SEQ ID NO: 233486 - DNA, 24 bp, Artificial sequence
  SiRNA target sequence
aaagctgttgccagaagtacagat

SEQ ID NO: 233487 - DNA, 24 bp, Artificial sequence
  SiRNA target sequence
aagctgttgccagaagtacagatt

SEQ ID NO: 233488 - DNA, 24 bp, Artificial sequence
  SiRNA target sequence
agctgttgccagaagtacagattt

SEQ ID NO: 233489 - DNA, 24 bp, Artificial sequence
  SiRNA target sequence
gctgttgccagaagtacagatttt

SEQ ID NO: 233490 - DNA, 24 bp, Artificial sequence
  SiRNA target sequence
ctgttgccagaagtacagattttt

SEQ ID NO: 233491 - DNA, 24 bp, Artificial sequence
  SiRNA target sequence
tgttgccagaagtacagatttttt

SEQ ID NO: 233492 - DNA, 24 bp, Artificial sequence
  SiRNA target sequence
gttgccagaagtacagatttttta

SEQ ID NO: 233493 - DNA, 24 bp, Artificial sequence
  SiRNA target sequence
ttgccagaagtacagattttttat

SEQ ID NO: 233494 - DNA, 24 bp, Artificial sequence
  SiRNA target sequence
tgccagaagtacagattttttatt

SEQ ID NO: 233495 - DNA, 24 bp, Artificial sequence
  SiRNA target sequence
gccagaagtacagattttttattt

SEQ ID NO: 233496 - DNA, 24 bp, Artificial sequence
  SiRNA target sequence
ccagaagtacagattttttatttt

SEQ ID NO: 233497 - DNA, 24 bp, Artificial sequence
  SiRNA target sequence
cagaagtacagattttttattttc

SEQ ID NO: 233498 - DNA, 24 bp, Artificial sequence
  SiRNA target sequence
agaagtacagattttttattttct

SEQ ID NO: 233499 - DNA, 24 bp, Artificial sequence
  SiRNA target sequence
gaagtacagattttttattttcta

SEQ ID NO: 233500 - DNA, 24 bp, Artificial sequence
  SiRNA target sequence
aagtacagattttttattttctat

SEQ ID NO: 233501 - DNA, 24 bp, Artificial sequence
  SiRNA target sequence
agtacagattttttattttctatt

SEQ ID NO: 233502 - DNA, 24 bp, Artificial sequence
  SiRNA target sequence
gtacagattttttattttctattg

SEQ ID NO: 233503 - DNA, 24 bp, Artificial sequence
  SiRNA target sequence
tacagattttttattttctattgc

SEQ ID NO: 233504 - DNA, 24 bp, Artificial sequence
  SiRNA target sequence
acagattttttattttctattgca

SEQ ID NO: 233505 - DNA, 24 bp, Artificial sequence
  SiRNA target sequence
cagattttttattttctattgcac

SEQ ID NO: 233506 - DNA, 24 bp, Artificial sequence
  SiRNA target sequence
agattttttattttctattgcact

SEQ ID NO: 233507 - DNA, 24 bp, Artificial sequence
  SiRNA target sequence
gattttttattttctattgcactt

SEQ ID NO: 233508 - DNA, 24 bp, Artificial sequence
  SiRNA target sequence
attttttattttctattgcacttg

SEQ ID NO: 233509 - DNA, 24 bp, Artificial sequence
  SiRNA target sequence
ttttttattttctattgcacttgt

SEQ ID NO: 233510 - DNA, 24 bp, Artificial sequence
  SiRNA target sequence
tttttattttctattgcacttgtt

SEQ ID NO: 233511 - DNA, 24 bp, Artificial sequence
  SiRNA target sequence
ttttattttctattgcacttgttt

SEQ ID NO: 233512 - DNA, 24 bp, Artificial sequence
  SiRNA target sequence
tttattttctattgcacttgtttt

SEQ ID NO: 233513 - DNA, 24 bp, Artificial sequence
  SiRNA target sequence
ttattttctattgcacttgttttc

SEQ ID NO: 233514 - DNA, 24 bp, Artificial sequence
  SiRNA target sequence
tattttctattgcacttgttttca

SEQ ID NO: 233515 - DNA, 24 bp, Artificial sequence
  SiRNA target sequence
attttctattgcacttgttttcaa

SEQ ID NO: 233516 - DNA, 24 bp, Artificial sequence
  SiRNA target sequence
ttttctattgcacttgttttcaat

SEQ ID NO: 233517 - DNA, 24 bp, Artificial sequence
  SiRNA target sequence
tttctattgcacttgttttcaatg

SEQ ID NO: 233518 - DNA, 24 bp, Artificial sequence
  SiRNA target sequence
ttctattgcacttgttttcaatga

SEQ ID NO: 233519 - DNA, 24 bp, Artificial sequence
  SiRNA target sequence
tctattgcacttgttttcaatgaa

SEQ ID NO: 233520 - DNA, 24 bp, Artificial sequence
  SiRNA target sequence
ctattgcacttgttttcaatgaat

SEQ ID NO: 233521 - DNA, 24 bp, Artificial sequence
  SiRNA target sequence
tattgcacttgttttcaatgaatg

SEQ ID NO: 233522 - DNA, 24 bp, Artificial sequence
  SiRNA target sequence
attgcacttgttttcaatgaatgg

SEQ ID NO: 233523 - DNA, 24 bp, Artificial sequence
  SiRNA target sequence
ttgcacttgttttcaatgaatgga

SEQ ID NO: 233524 - DNA, 24 bp, Artificial sequence
  SiRNA target sequence
tgcacttgttttcaatgaatggac

SEQ ID NO: 233525 - DNA, 24 bp, Artificial sequence
  SiRNA target sequence
gcacttgttttcaatgaatggaca

SEQ ID NO: 233526 - DNA, 24 bp, Artificial sequence
  SiRNA target sequence
cacttgttttcaatgaatggacaa

SEQ ID NO: 233527 - DNA, 24 bp, Artificial sequence
  SiRNA target sequence
acttgttttcaatgaatggacaag

SEQ ID NO: 233528 - DNA, 24 bp, Artificial sequence
  SiRNA target sequence
cttgttttcaatgaatggacaagt

SEQ ID NO: 233529 - DNA, 24 bp, Artificial sequence
  SiRNA target sequence
ttgttttcaatgaatggacaagtt

SEQ ID NO: 233530 - DNA, 24 bp, Artificial sequence
  SiRNA target sequence
tgttttcaatgaatggacaagttc

SEQ ID NO: 233531 - DNA, 24 bp, Artificial sequence
  SiRNA target sequence
gttttcaatgaatggacaagttct

SEQ ID NO: 233532 - DNA, 24 bp, Artificial sequence
  SiRNA target sequence
ttttcaatgaatggacaagttctg

SEQ ID NO: 233533 - DNA, 24 bp, Artificial sequence
  SiRNA target sequence
tttcaatgaatggacaagttctgc

SEQ ID NO: 233534 - DNA, 24 bp, Artificial sequence
  SiRNA target sequence
ttcaatgaatggacaagttctgct

SEQ ID NO: 233535 - DNA, 24 bp, Artificial sequence
  SiRNA target sequence
tcaatgaatggacaagttctgcta

SEQ ID NO: 233536 - DNA, 24 bp, Artificial sequence
  SiRNA target sequence
caatgaatggacaagttctgctat

SEQ ID NO: 233537 - DNA, 24 bp, Artificial sequence
  SiRNA target sequence
aatgaatggacaagttctgctatc

SEQ ID NO: 233538 - DNA, 24 bp, Artificial sequence
  SiRNA target sequence
atgaatggacaagttctgctatct

SEQ ID NO: 233539 - DNA, 24 bp, Artificial sequence
  SiRNA target sequence
tgaatggacaagttctgctatcta

SEQ ID NO: 233540 - DNA, 24 bp, Artificial sequence
  SiRNA target sequence
gaatggacaagttctgctatctat

SEQ ID NO: 233541 - DNA, 24 bp, Artificial sequence
  SiRNA target sequence
aatggacaagttctgctatctatg

SEQ ID NO: 233542 - DNA, 24 bp, Artificial sequence
  SiRNA target sequence
atggacaagttctgctatctatgt

SEQ ID NO: 233543 - DNA, 24 bp, Artificial sequence
  SiRNA target sequence
tggacaagttctgctatctatgtt

SEQ ID NO: 233544 - DNA, 24 bp, Artificial sequence
  SiRNA target sequence
ggacaagttctgctatctatgttt

SEQ ID NO: 233545 - DNA, 24 bp, Artificial sequence
  SiRNA target sequence
gacaagttctgctatctatgtttt

SEQ ID NO: 233546 - DNA, 24 bp, Artificial sequence
  SiRNA target sequence
acaagttctgctatctatgtttta

SEQ ID NO: 233547 - DNA, 24 bp, Artificial sequence
  SiRNA target sequence
caagttctgctatctatgttttat

SEQ ID NO: 233548 - DNA, 24 bp, Artificial sequence
  SiRNA target sequence
aagttctgctatctatgttttatc

SEQ ID NO: 233549 - DNA, 24 bp, Artificial sequence
  SiRNA target sequence
agttctgctatctatgttttatct

SEQ ID NO: 233550 - DNA, 24 bp, Artificial sequence
  SiRNA target sequence
gttctgctatctatgttttatctg

SEQ ID NO: 233551 - DNA, 24 bp, Artificial sequence
  SiRNA target sequence
ttctgctatctatgttttatctga

SEQ ID NO: 233552 - DNA, 24 bp, Artificial sequence
  SiRNA target sequence
tctgctatctatgttttatctgaa

SEQ ID NO: 233553 - DNA, 24 bp, Artificial sequence
  SiRNA target sequence
ctgctatctatgttttatctgaaa

SEQ ID NO: 233554 - DNA, 24 bp, Artificial sequence
  SiRNA target sequence
tgctatctatgttttatctgaaat

SEQ ID NO: 233555 - DNA, 24 bp, Artificial sequence
  SiRNA target sequence
gctatctatgttttatctgaaatg

SEQ ID NO: 233556 - DNA, 24 bp, Artificial sequence
  SiRNA target sequence
ctatctatgttttatctgaaatgt

SEQ ID NO: 233557 - DNA, 24 bp, Artificial sequence
  SiRNA target sequence
tatctatgttttatctgaaatgtt

SEQ ID NO: 233558 - DNA, 24 bp, Artificial sequence
  SiRNA target sequence
atctatgttttatctgaaatgttt

SEQ ID NO: 233559 - DNA, 24 bp, Artificial sequence
  SiRNA target sequence
tctatgttttatctgaaatgtttg

SEQ ID NO: 233560 - DNA, 24 bp, Artificial sequence
  SiRNA target sequence
ctatgttttatctgaaatgtttgg

SEQ ID NO: 233561 - DNA, 24 bp, Artificial sequence
  SiRNA target sequence
tatgttttatctgaaatgtttggt

SEQ ID NO: 233562 - DNA, 24 bp, Artificial sequence
  SiRNA target sequence
atgttttatctgaaatgtttggta

SEQ ID NO: 233563 - DNA, 24 bp, Artificial sequence
  SiRNA target sequence
tgttttatctgaaatgtttggtag

SEQ ID NO: 233564 - DNA, 24 bp, Artificial sequence
  SiRNA target sequence
gttttatctgaaatgtttggtagt

SEQ ID NO: 233565 - DNA, 24 bp, Artificial sequence
  SiRNA target sequence
ttttatctgaaatgtttggtagtt

SEQ ID NO: 233566 - DNA, 24 bp, Artificial sequence
  SiRNA target sequence
tttatctgaaatgtttggtagttt

SEQ ID NO: 233567 - DNA, 24 bp, Artificial sequence
  SiRNA target sequence
ttatctgaaatgtttggtagtttg

SEQ ID NO: 233568 - DNA, 24 bp, Artificial sequence
  SiRNA target sequence
tatctgaaatgtttggtagtttga

SEQ ID NO: 233569 - DNA, 24 bp, Artificial sequence
  SiRNA target sequence
atctgaaatgtttggtagtttgat

SEQ ID NO: 233570 - DNA, 24 bp, Artificial sequence
  SiRNA target sequence
tctgaaatgtttggtagtttgatt

SEQ ID NO: 233571 - DNA, 24 bp, Artificial sequence
  SiRNA target sequence
ctgaaatgtttggtagtttgattc

SEQ ID NO: 233572 - DNA, 24 bp, Artificial sequence
  SiRNA target sequence
tgaaatgtttggtagtttgattct

SEQ ID NO: 233573 - DNA, 24 bp, Artificial sequence
  SiRNA target sequence
gaaatgtttggtagtttgattctt

SEQ ID NO: 233574 - DNA, 24 bp, Artificial sequence
  SiRNA target sequence
aaatgtttggtagtttgattcttt

SEQ ID NO: 233575 - DNA, 24 bp, Artificial sequence
  SiRNA target sequence
aatgtttggtagtttgattctttc

SEQ ID NO: 233576 - DNA, 24 bp, Artificial sequence
  SiRNA target sequence
atgtttggtagtttgattctttca

SEQ ID NO: 233577 - DNA, 24 bp, Artificial sequence
  SiRNA target sequence
tgtttggtagtttgattctttcat

SEQ ID NO: 233578 - DNA, 24 bp, Artificial sequence
  SiRNA target sequence
gtttggtagtttgattctttcata

SEQ ID NO: 233579 - DNA, 24 bp, Artificial sequence
  SiRNA target sequence
tttggtagtttgattctttcatat

SEQ ID NO: 233580 - DNA, 24 bp, Artificial sequence
  SiRNA target sequence
ttggtagtttgattctttcatatt

SEQ ID NO: 233581 - DNA, 24 bp, Artificial sequence
  SiRNA target sequence
tggtagtttgattctttcatattt

SEQ ID NO: 233582 - DNA, 24 bp, Artificial sequence
  SiRNA target sequence
ggtagtttgattctttcatattta

SEQ ID NO: 233583 - DNA, 24 bp, Artificial sequence
  SiRNA target sequence
gtagtttgattctttcatatttat

SEQ ID NO: 233584 - DNA, 24 bp, Artificial sequence
  SiRNA target sequence
tagtttgattctttcatatttatt

SEQ ID NO: 233585 - DNA, 24 bp, Artificial sequence
  SiRNA target sequence
agtttgattctttcatatttattt

SEQ ID NO: 233586 - DNA, 24 bp, Artificial sequence
  SiRNA target sequence
gtttgattctttcatatttattta

SEQ ID NO: 233587 - DNA, 24 bp, Artificial sequence
  SiRNA target sequence
tttgattctttcatatttatttat

SEQ ID NO: 233588 - DNA, 24 bp, Artificial sequence
  SiRNA target sequence
ttgattctttcatatttatttatg

SEQ ID NO: 233589 - DNA, 24 bp, Artificial sequence
  SiRNA target sequence
tgattctttcatatttatttatga

SEQ ID NO: 233590 - DNA, 24 bp, Artificial sequence
  SiRNA target sequence
gattctttcatatttatttatgac

SEQ ID NO: 233591 - DNA, 24 bp, Artificial sequence
  SiRNA target sequence
attctttcatatttatttatgacg

SEQ ID NO: 233592 - DNA, 24 bp, Artificial sequence
  SiRNA target sequence
ttctttcatatttatttatgacgt

SEQ ID NO: 233593 - DNA, 24 bp, Artificial sequence
  SiRNA target sequence
tctttcatatttatttatgacgtt

SEQ ID NO: 233594 - DNA, 24 bp, Artificial sequence
  SiRNA target sequence
ctttcatatttatttatgacgttt

SEQ ID NO: 233595 - DNA, 24 bp, Artificial sequence
  SiRNA target sequence
tttcatatttatttatgacgtttg

SEQ ID NO: 233596 - DNA, 24 bp, Artificial sequence
  SiRNA target sequence
ttcatatttatttatgacgtttgc

SEQ ID NO: 233597 - DNA, 24 bp, Artificial sequence
  SiRNA target sequence
tcatatttatttatgacgtttgct

SEQ ID NO: 233598 - DNA, 24 bp, Artificial sequence
  SiRNA target sequence
catatttatttatgacgtttgcta

SEQ ID NO: 233599 - DNA, 24 bp, Artificial sequence
  SiRNA target sequence
atatttatttatgacgtttgctaa

SEQ ID NO: 233600 - DNA, 24 bp, Artificial sequence
  SiRNA target sequence
tatttatttatgacgtttgctaat

SEQ ID NO: 233601 - DNA, 24 bp, Artificial sequence
  SiRNA target sequence
atttatttatgacgtttgctaatg

SEQ ID NO: 233602 - DNA, 24 bp, Artificial sequence
  SiRNA target sequence
tttatttatgacgtttgctaatgg

SEQ ID NO: 233603 - DNA, 24 bp, Artificial sequence
  SiRNA target sequence
ttatttatgacgtttgctaatggt

SEQ ID NO: 233604 - DNA, 24 bp, Artificial sequence
  SiRNA target sequence
tatttatgacgtttgctaatggtc

SEQ ID NO: 233605 - DNA, 24 bp, Artificial sequence
  SiRNA target sequence
atttatgacgtttgctaatggtct

SEQ ID NO: 233606 - DNA, 24 bp, Artificial sequence
  SiRNA target sequence
tttatgacgtttgctaatggtctt

SEQ ID NO: 233607 - DNA, 24 bp, Artificial sequence
  SiRNA target sequence
ttatgacgtttgctaatggtcttt

SEQ ID NO: 233608 - DNA, 24 bp, Artificial sequence
  SiRNA target sequence
tatgacgtttgctaatggtctttc

SEQ ID NO: 233609 - DNA, 24 bp, Artificial sequence
  SiRNA target sequence
atgacgtttgctaatggtctttcg

SEQ ID NO: 233610 - DNA, 24 bp, Artificial sequence
  SiRNA target sequence
tgacgtttgctaatggtctttcga

SEQ ID NO: 233611 - DNA, 24 bp, Artificial sequence
  SiRNA target sequence
gacgtttgctaatggtctttcgac

SEQ ID NO: 233612 - DNA, 24 bp, Artificial sequence
  SiRNA target sequence
acgtttgctaatggtctttcgact

SEQ ID NO: 233613 - DNA, 24 bp, Artificial sequence
  SiRNA target sequence
cgtttgctaatggtctttcgactc

SEQ ID NO: 233614 - DNA, 24 bp, Artificial sequence
  SiRNA target sequence
gtttgctaatggtctttcgactcc

SEQ ID NO: 233615 - DNA, 24 bp, Artificial sequence
  SiRNA target sequence
tttgctaatggtctttcgactcct

SEQ ID NO: 233616 - DNA, 24 bp, Artificial sequence
  SiRNA target sequence
ttgctaatggtctttcgactcctg

SEQ ID NO: 233617 - DNA, 24 bp, Artificial sequence
  SiRNA target sequence
tgctaatggtctttcgactcctgg

SEQ ID NO: 233618 - DNA, 24 bp, Artificial sequence
  SiRNA target sequence
gctaatggtctttcgactcctgga

SEQ ID NO: 233619 - DNA, 24 bp, Artificial sequence
  SiRNA target sequence
ctaatggtctttcgactcctggac

SEQ ID NO: 233620 - DNA, 24 bp, Artificial sequence
  SiRNA target sequence
taatggtctttcgactcctggaca

SEQ ID NO: 233621 - DNA, 24 bp, Artificial sequence
  SiRNA target sequence
aatggtctttcgactcctggacag

SEQ ID NO: 233622 - DNA, 24 bp, Artificial sequence
  SiRNA target sequence
atggtctttcgactcctggacagt

SEQ ID NO: 233623 - DNA, 24 bp, Artificial sequence
  SiRNA target sequence
tggtctttcgactcctggacagtc

SEQ ID NO: 233624 - DNA, 24 bp, Artificial sequence
  SiRNA target sequence
ggtctttcgactcctggacagtcc

SEQ ID NO: 233625 - DNA, 24 bp, Artificial sequence
  SiRNA target sequence
gtctttcgactcctggacagtccg

SEQ ID NO: 233626 - DNA, 24 bp, Artificial sequence
  SiRNA target sequence
tctttcgactcctggacagtccgc

SEQ ID NO: 233627 - DNA, 24 bp, Artificial sequence
  SiRNA target sequence
ctttcgactcctggacagtccgct

SEQ ID NO: 233628 - DNA, 24 bp, Artificial sequence
  SiRNA target sequence
tttcgactcctggacagtccgcta

SEQ ID NO: 233629 - DNA, 24 bp, Artificial sequence
  SiRNA target sequence
ttcgactcctggacagtccgctag

SEQ ID NO: 233630 - DNA, 24 bp, Artificial sequence
  SiRNA target sequence
tcgactcctggacagtccgctaga

SEQ ID NO: 233631 - DNA, 24 bp, Artificial sequence
  SiRNA target sequence
cgactcctggacagtccgctagat

SEQ ID NO: 233632 - DNA, 24 bp, Artificial sequence
  SiRNA target sequence
gactcctggacagtccgctagatt

SEQ ID NO: 233633 - DNA, 24 bp, Artificial sequence
  SiRNA target sequence
actcctggacagtccgctagattt

SEQ ID NO: 233634 - DNA, 24 bp, Artificial sequence
  SiRNA target sequence
ctcctggacagtccgctagatttg

SEQ ID NO: 233635 - DNA, 24 bp, Artificial sequence
  SiRNA target sequence
tcctggacagtccgctagatttgt

SEQ ID NO: 233636 - DNA, 24 bp, Artificial sequence
  SiRNA target sequence
cctggacagtccgctagatttgtc

SEQ ID NO: 233637 - DNA, 24 bp, Artificial sequence
  SiRNA target sequence
ctggacagtccgctagatttgtcc

SEQ ID NO: 233638 - DNA, 24 bp, Artificial sequence
  SiRNA target sequence
tggacagtccgctagatttgtccc

SEQ ID NO: 233639 - DNA, 24 bp, Artificial sequence
  SiRNA target sequence
ggacagtccgctagatttgtccct

SEQ ID NO: 233640 - DNA, 24 bp, Artificial sequence
  SiRNA target sequence
gacagtccgctagatttgtccctt

SEQ ID NO: 233641 - DNA, 24 bp, Artificial sequence
  SiRNA target sequence
acagtccgctagatttgtcccttt

SEQ ID NO: 233642 - DNA, 24 bp, Artificial sequence
  SiRNA target sequence
cagtccgctagatttgtcccttta

SEQ ID NO: 233643 - DNA, 24 bp, Artificial sequence
  SiRNA target sequence
agtccgctagatttgtccctttat

SEQ ID NO: 233644 - DNA, 24 bp, Artificial sequence
  SiRNA target sequence
gtccgctagatttgtccctttatt

SEQ ID NO: 233645 - DNA, 24 bp, Artificial sequence
  SiRNA target sequence
tccgctagatttgtccctttattt

SEQ ID NO: 233646 - DNA, 24 bp, Artificial sequence
  SiRNA target sequence
ccgctagatttgtccctttatttt

SEQ ID NO: 233647 - DNA, 24 bp, Artificial sequence
  SiRNA target sequence
cgctagatttgtccctttatttta

SEQ ID NO: 233648 - DNA, 24 bp, Artificial sequence
  SiRNA target sequence
gctagatttgtccctttattttat

SEQ ID NO: 233649 - DNA, 24 bp, Artificial sequence
  SiRNA target sequence
ctagatttgtccctttattttatg

SEQ ID NO: 233650 - DNA, 24 bp, Artificial sequence
  SiRNA target sequence
tagatttgtccctttattttatgt

SEQ ID NO: 233651 - DNA, 24 bp, Artificial sequence
  SiRNA target sequence
agatttgtccctttattttatgtt

SEQ ID NO: 233652 - DNA, 24 bp, Artificial sequence
  SiRNA target sequence
gatttgtccctttattttatgttg

SEQ ID NO: 233653 - DNA, 24 bp, Artificial sequence
  SiRNA target sequence
atttgtccctttattttatgttgg

SEQ ID NO: 233654 - DNA, 24 bp, Artificial sequence
  SiRNA target sequence
tttgtccctttattttatgttgga

SEQ ID NO: 233655 - DNA, 24 bp, Artificial sequence
  SiRNA target sequence
ttgtccctttattttatgttggat

SEQ ID NO: 233656 - DNA, 24 bp, Artificial sequence
  SiRNA target sequence
tgtccctttattttatgttggatc

SEQ ID NO: 233657 - DNA, 24 bp, Artificial sequence
  SiRNA target sequence
gtccctttattttatgttggatct

SEQ ID NO: 233658 - DNA, 24 bp, Artificial sequence
  SiRNA target sequence
tccctttattttatgttggatcta

SEQ ID NO: 233659 - DNA, 24 bp, Artificial sequence
  SiRNA target sequence
ccctttattttatgttggatctaa

SEQ ID NO: 233660 - DNA, 24 bp, Artificial sequence
  SiRNA target sequence
cctttattttatgttggatctaat

SEQ ID NO: 233661 - DNA, 24 bp, Artificial sequence
  SiRNA target sequence
ctttattttatgttggatctaatt

SEQ ID NO: 233662 - DNA, 24 bp, Artificial sequence
  SiRNA target sequence
tttattttatgttggatctaattt

SEQ ID NO: 233663 - DNA, 24 bp, Artificial sequence
  SiRNA target sequence
ttattttatgttggatctaatttg

SEQ ID NO: 233664 - DNA, 24 bp, Artificial sequence
  SiRNA target sequence
tattttatgttggatctaatttgg

SEQ ID NO: 233665 - DNA, 24 bp, Artificial sequence
  SiRNA target sequence
attttatgttggatctaatttggc

SEQ ID NO: 233666 - DNA, 24 bp, Artificial sequence
  SiRNA target sequence
ttttatgttggatctaatttggct

SEQ ID NO: 233667 - DNA, 24 bp, Artificial sequence
  SiRNA target sequence
tttatgttggatctaatttggctt

SEQ ID NO: 233668 - DNA, 24 bp, Artificial sequence
  SiRNA target sequence
ttatgttggatctaatttggcttt

SEQ ID NO: 233669 - DNA, 24 bp, Artificial sequence
  SiRNA target sequence
tatgttggatctaatttggcttta

SEQ ID NO: 233670 - DNA, 24 bp, Artificial sequence
  SiRNA target sequence
atgttggatctaatttggctttac

SEQ ID NO: 233671 - DNA, 24 bp, Artificial sequence
  SiRNA target sequence
tgttggatctaatttggctttact

SEQ ID NO: 233672 - DNA, 24 bp, Artificial sequence
  SiRNA target sequence
gttggatctaatttggctttactt

SEQ ID NO: 233673 - DNA, 24 bp, Artificial sequence
  SiRNA target sequence
ttggatctaatttggctttacttc

SEQ ID NO: 233674 - DNA, 24 bp, Artificial sequence
  SiRNA target sequence
tggatctaatttggctttacttct

SEQ ID NO: 233675 - DNA, 24 bp, Artificial sequence
  SiRNA target sequence
ggatctaatttggctttacttctt

SEQ ID NO: 233676 - DNA, 24 bp, Artificial sequence
  SiRNA target sequence
gatctaatttggctttacttcttt

SEQ ID NO: 233677 - DNA, 24 bp, Artificial sequence
  SiRNA target sequence
atctaatttggctttacttctttc

SEQ ID NO: 233678 - DNA, 24 bp, Artificial sequence
  SiRNA target sequence
tctaatttggctttacttctttca

SEQ ID NO: 233679 - DNA, 24 bp, Artificial sequence
  SiRNA target sequence
ctaatttggctttacttctttcag

SEQ ID NO: 233680 - DNA, 24 bp, Artificial sequence
  SiRNA target sequence
taatttggctttacttctttcagg

SEQ ID NO: 233681 - DNA, 24 bp, Artificial sequence
  SiRNA target sequence
aatttggctttacttctttcagga

SEQ ID NO: 233682 - DNA, 24 bp, Artificial sequence
  SiRNA target sequence
atttggctttacttctttcaggaa

SEQ ID NO: 233683 - DNA, 24 bp, Artificial sequence
  SiRNA target sequence
tttggctttacttctttcaggaat

SEQ ID NO: 233684 - DNA, 24 bp, Artificial sequence
  SiRNA target sequence
ttggctttacttctttcaggaatg

SEQ ID NO: 233685 - DNA, 24 bp, Artificial sequence
  SiRNA target sequence
tggctttacttctttcaggaatga

SEQ ID NO: 233686 - DNA, 24 bp, Artificial sequence
  SiRNA target sequence
ggctttacttctttcaggaatgat

SEQ ID NO: 233687 - DNA, 24 bp, Artificial sequence
  SiRNA target sequence
gctttacttctttcaggaatgata

SEQ ID NO: 233688 - DNA, 24 bp, Artificial sequence
  SiRNA target sequence
ctttacttctttcaggaatgataa

SEQ ID NO: 233689 - DNA, 24 bp, Artificial sequence
  SiRNA target sequence
tttacttctttcaggaatgataaa

SEQ ID NO: 233690 - DNA, 24 bp, Artificial sequence
  SiRNA target sequence
ttacttctttcaggaatgataaat

SEQ ID NO: 233691 - DNA, 24 bp, Artificial sequence
  SiRNA target sequence
tacttctttcaggaatgataaatt

SEQ ID NO: 233692 - DNA, 24 bp, Artificial sequence
  SiRNA target sequence
acttctttcaggaatgataaatta

SEQ ID NO: 233693 - DNA, 24 bp, Artificial sequence
  SiRNA target sequence
cttctttcaggaatgataaattac

SEQ ID NO: 233694 - DNA, 24 bp, Artificial sequence
  SiRNA target sequence
ttctttcaggaatgataaattact

SEQ ID NO: 233695 - DNA, 24 bp, Artificial sequence
  SiRNA target sequence
tctttcaggaatgataaattactt

SEQ ID NO: 233696 - DNA, 24 bp, Artificial sequence
  SiRNA target sequence
ctttcaggaatgataaattacttt

SEQ ID NO: 233697 - DNA, 24 bp, Artificial sequence
  SiRNA target sequence
tttcaggaatgataaattactttt

SEQ ID NO: 233698 - DNA, 24 bp, Artificial sequence
  SiRNA target sequence
ttcaggaatgataaattactttta

SEQ ID NO: 233699 - DNA, 24 bp, Artificial sequence
  SiRNA target sequence
tcaggaatgataaattacttttat

SEQ ID NO: 233700 - DNA, 24 bp, Artificial sequence
  SiRNA target sequence
caggaatgataaattacttttata

SEQ ID NO: 233701 - DNA, 24 bp, Artificial sequence
  SiRNA target sequence
aggaatgataaattacttttatag

SEQ ID NO: 233702 - DNA, 24 bp, Artificial sequence
  SiRNA target sequence
ggaatgataaattacttttatagt

SEQ ID NO: 233703 - DNA, 24 bp, Artificial sequence
  SiRNA target sequence
gaatgataaattacttttatagtg

SEQ ID NO: 233704 - DNA, 24 bp, Artificial sequence
  SiRNA target sequence
aatgataaattacttttatagtgt

SEQ ID NO: 233705 - DNA, 24 bp, Artificial sequence
  SiRNA target sequence
atgataaattacttttatagtgta

SEQ ID NO: 233706 - DNA, 24 bp, Artificial sequence
  SiRNA target sequence
tgataaattacttttatagtgtaa

SEQ ID NO: 233707 - DNA, 24 bp, Artificial sequence
  SiRNA target sequence
gataaattacttttatagtgtaag

SEQ ID NO: 233708 - DNA, 24 bp, Artificial sequence
  SiRNA target sequence
ataaattacttttatagtgtaagt

SEQ ID NO: 233709 - DNA, 24 bp, Artificial sequence
  SiRNA target sequence
taaattacttttatagtgtaagta

SEQ ID NO: 233710 - DNA, 24 bp, Artificial sequence
  SiRNA target sequence
aaattacttttatagtgtaagtaa

SEQ ID NO: 233711 - DNA, 24 bp, Artificial sequence
  SiRNA target sequence
aattacttttatagtgtaagtaaa

SEQ ID NO: 233712 - DNA, 24 bp, Artificial sequence
  SiRNA target sequence
attacttttatagtgtaagtaaat

SEQ ID NO: 233713 - DNA, 24 bp, Artificial sequence
  SiRNA target sequence
ttacttttatagtgtaagtaaatc

SEQ ID NO: 233714 - DNA, 24 bp, Artificial sequence
  SiRNA target sequence
tacttttatagtgtaagtaaatct

SEQ ID NO: 233715 - DNA, 24 bp, Artificial sequence
  SiRNA target sequence
acttttatagtgtaagtaaatcta

SEQ ID NO: 233716 - DNA, 24 bp, Artificial sequence
  SiRNA target sequence
cttttatagtgtaagtaaatctaa

SEQ ID NO: 233717 - DNA, 24 bp, Artificial sequence
  SiRNA target sequence
ttttatagtgtaagtaaatctaaa

SEQ ID NO: 233718 - DNA, 24 bp, Artificial sequence
  SiRNA target sequence
tttatagtgtaagtaaatctaaaa

SEQ ID NO: 233719 - DNA, 24 bp, Artificial sequence
  SiRNA target sequence
ttatagtgtaagtaaatctaaaat

SEQ ID NO: 233720 - DNA, 24 bp, Artificial sequence
  SiRNA target sequence
tatagtgtaagtaaatctaaaatg

SEQ ID NO: 233721 - DNA, 24 bp, Artificial sequence
  SiRNA target sequence
atagtgtaagtaaatctaaaatgt

SEQ ID NO: 233722 - DNA, 24 bp, Artificial sequence
  SiRNA target sequence
tagtgtaagtaaatctaaaatgtc

SEQ ID NO: 233723 - DNA, 24 bp, Artificial sequence
  SiRNA target sequence
agtgtaagtaaatctaaaatgtcg

SEQ ID NO: 233724 - DNA, 24 bp, Artificial sequence
  SiRNA target sequence
gtgtaagtaaatctaaaatgtcgt

SEQ ID NO: 233725 - DNA, 24 bp, Artificial sequence
  SiRNA target sequence
tgtaagtaaatctaaaatgtcgta

SEQ ID NO: 233726 - DNA, 24 bp, Artificial sequence
  SiRNA target sequence
gtaagtaaatctaaaatgtcgtat

SEQ ID NO: 233727 - DNA, 24 bp, Artificial sequence
  SiRNA target sequence
taagtaaatctaaaatgtcgtatg

SEQ ID NO: 233728 - DNA, 24 bp, Artificial sequence
  SiRNA target sequence
aagtaaatctaaaatgtcgtatgt

SEQ ID NO: 233729 - DNA, 24 bp, Artificial sequence
  SiRNA target sequence
agtaaatctaaaatgtcgtatgtt

SEQ ID NO: 233730 - DNA, 24 bp, Artificial sequence
  SiRNA target sequence
gtaaatctaaaatgtcgtatgttg

SEQ ID NO: 233731 - DNA, 24 bp, Artificial sequence
  SiRNA target sequence
taaatctaaaatgtcgtatgttgc

SEQ ID NO: 233732 - DNA, 24 bp, Artificial sequence
  SiRNA target sequence
aaatctaaaatgtcgtatgttgcg

SEQ ID NO: 233733 - DNA, 24 bp, Artificial sequence
  SiRNA target sequence
aatctaaaatgtcgtatgttgcgg

SEQ ID NO: 233734 - DNA, 24 bp, Artificial sequence
  SiRNA target sequence
atctaaaatgtcgtatgttgcggc

SEQ ID NO: 233735 - DNA, 24 bp, Artificial sequence
  SiRNA target sequence
tctaaaatgtcgtatgttgcggcc

SEQ ID NO: 233736 - DNA, 24 bp, Artificial sequence
  SiRNA target sequence
ctaaaatgtcgtatgttgcggccg

SEQ ID NO: 233737 - DNA, 24 bp, Artificial sequence
  SiRNA target sequence
taaaatgtcgtatgttgcggccga

SEQ ID NO: 233738 - DNA, 24 bp, Artificial sequence
  SiRNA target sequence
aaaatgtcgtatgttgcggccgaa

SEQ ID NO: 233739 - DNA, 24 bp, Artificial sequence
  SiRNA target sequence
aaatgtcgtatgttgcggccgaaa

SEQ ID NO: 233740 - DNA, 24 bp, Artificial sequence
  SiRNA target sequence
aatgtcgtatgttgcggccgaaag

SEQ ID NO: 233741 - DNA, 24 bp, Artificial sequence
  SiRNA target sequence
atgtcgtatgttgcggccgaaaga

SEQ ID NO: 233742 - DNA, 24 bp, Artificial sequence
  SiRNA target sequence
tgtcgtatgttgcggccgaaagat

SEQ ID NO: 233743 - DNA, 24 bp, Artificial sequence
  SiRNA target sequence
gtcgtatgttgcggccgaaagatt

SEQ ID NO: 233744 - DNA, 24 bp, Artificial sequence
  SiRNA target sequence
tcgtatgttgcggccgaaagattt

SEQ ID NO: 233745 - DNA, 24 bp, Artificial sequence
  SiRNA target sequence
cgtatgttgcggccgaaagatttt

SEQ ID NO: 233746 - DNA, 24 bp, Artificial sequence
  SiRNA target sequence
gtatgttgcggccgaaagattttt

SEQ ID NO: 233747 - DNA, 24 bp, Artificial sequence
  SiRNA target sequence
tatgttgcggccgaaagatttttt

SEQ ID NO: 233748 - DNA, 24 bp, Artificial sequence
  SiRNA target sequence
atgttgcggccgaaagatttttta

SEQ ID NO: 233749 - DNA, 24 bp, Artificial sequence
  SiRNA target sequence
tgttgcggccgaaagattttttaa

SEQ ID NO: 233750 - DNA, 24 bp, Artificial sequence
  SiRNA target sequence
gttgcggccgaaagattttttaat

SEQ ID NO: 233751 - DNA, 24 bp, Artificial sequence
  SiRNA target sequence
ttgcggccgaaagattttttaatg

SEQ ID NO: 233752 - DNA, 24 bp, Artificial sequence
  SiRNA target sequence
tgcggccgaaagattttttaatgg

SEQ ID NO: 233753 - DNA, 24 bp, Artificial sequence
  SiRNA target sequence
gcggccgaaagattttttaatgga

SEQ ID NO: 233754 - DNA, 24 bp, Artificial sequence
  SiRNA target sequence
cggccgaaagattttttaatggat

SEQ ID NO: 233755 - DNA, 24 bp, Artificial sequence
  SiRNA target sequence
ggccgaaagattttttaatggatt

SEQ ID NO: 233756 - DNA, 24 bp, Artificial sequence
  SiRNA target sequence
gccgaaagattttttaatggattt

SEQ ID NO: 233757 - DNA, 24 bp, Artificial sequence
  SiRNA target sequence
ccgaaagattttttaatggatttt

SEQ ID NO: 233758 - DNA, 24 bp, Artificial sequence
  SiRNA target sequence
cgaaagattttttaatggattttt

SEQ ID NO: 233759 - DNA, 24 bp, Artificial sequence
  SiRNA target sequence
gaaagattttttaatggatttttt

SEQ ID NO: 233760 - DNA, 24 bp, Artificial sequence
  SiRNA target sequence
aaagattttttaatggattttttt

SEQ ID NO: 233761 - DNA, 24 bp, Artificial sequence
  SiRNA target sequence
aagattttttaatggatttttttg

SEQ ID NO: 233762 - DNA, 24 bp, Artificial sequence
  SiRNA target sequence
agattttttaatggatttttttgt

SEQ ID NO: 233763 - DNA, 24 bp, Artificial sequence
  SiRNA target sequence
gattttttaatggatttttttgtc

SEQ ID NO: 233764 - DNA, 24 bp, Artificial sequence
  SiRNA target sequence
attttttaatggatttttttgtct

SEQ ID NO: 233765 - DNA, 24 bp, Artificial sequence
  SiRNA target sequence
ttttttaatggatttttttgtctg

SEQ ID NO: 233766 - DNA, 24 bp, Artificial sequence
  SiRNA target sequence
tttttaatggatttttttgtctga

SEQ ID NO: 233767 - DNA, 24 bp, Artificial sequence
  SiRNA target sequence
ttttaatggatttttttgtctgag

SEQ ID NO: 233768 - DNA, 24 bp, Artificial sequence
  SiRNA target sequence
tttaatggatttttttgtctgagt

SEQ ID NO: 233769 - DNA, 24 bp, Artificial sequence
  SiRNA target sequence
ttaatggatttttttgtctgagtg

SEQ ID NO: 233770 - DNA, 24 bp, Artificial sequence
  SiRNA target sequence
taatggatttttttgtctgagtgg

SEQ ID NO: 233771 - DNA, 24 bp, Artificial sequence
  SiRNA target sequence
aatggatttttttgtctgagtgga

SEQ ID NO: 233772 - DNA, 24 bp, Artificial sequence
  SiRNA target sequence
atggatttttttgtctgagtggaa

SEQ ID NO: 233773 - DNA, 24 bp, Artificial sequence
  SiRNA target sequence
tggatttttttgtctgagtggaat

SEQ ID NO: 233774 - DNA, 24 bp, Artificial sequence
  SiRNA target sequence
ggatttttttgtctgagtggaatt

SEQ ID NO: 233775 - DNA, 24 bp, Artificial sequence
  SiRNA target sequence
gatttttttgtctgagtggaattc

SEQ ID NO: 233776 - DNA, 24 bp, Artificial sequence
  SiRNA target sequence
atttttttgtctgagtggaattct

SEQ ID NO: 233777 - DNA, 24 bp, Artificial sequence
  SiRNA target sequence
tttttttgtctgagtggaattctc

SEQ ID NO: 233778 - DNA, 24 bp, Artificial sequence
  SiRNA target sequence
ttttttgtctgagtggaattctct

SEQ ID NO: 233779 - DNA, 24 bp, Artificial sequence
  SiRNA target sequence
tttttgtctgagtggaattctctg

SEQ ID NO: 233780 - DNA, 24 bp, Artificial sequence
  SiRNA target sequence
ttttgtctgagtggaattctctgt

SEQ ID NO: 233781 - DNA, 24 bp, Artificial sequence
  SiRNA target sequence
tttgtctgagtggaattctctgtg

SEQ ID NO: 233782 - DNA, 24 bp, Artificial sequence
  SiRNA target sequence
ttgtctgagtggaattctctgtgc

SEQ ID NO: 233783 - DNA, 24 bp, Artificial sequence
  SiRNA target sequence
tgtctgagtggaattctctgtgct

SEQ ID NO: 233784 - DNA, 24 bp, Artificial sequence
  SiRNA target sequence
gtctgagtggaattctctgtgctg

SEQ ID NO: 233785 - DNA, 24 bp, Artificial sequence
  SiRNA target sequence
tctgagtggaattctctgtgctgt

SEQ ID NO: 233786 - DNA, 24 bp, Artificial sequence
  SiRNA target sequence
ctgagtggaattctctgtgctgta

SEQ ID NO: 233787 - DNA, 24 bp, Artificial sequence
  SiRNA target sequence
tgagtggaattctctgtgctgtaa

SEQ ID NO: 233788 - DNA, 24 bp, Artificial sequence
  SiRNA target sequence
gagtggaattctctgtgctgtaat

SEQ ID NO: 233789 - DNA, 24 bp, Artificial sequence
  SiRNA target sequence
agtggaattctctgtgctgtaatt

SEQ ID NO: 233790 - DNA, 24 bp, Artificial sequence
  SiRNA target sequence
gtggaattctctgtgctgtaattt

SEQ ID NO: 233791 - DNA, 24 bp, Artificial sequence
  SiRNA target sequence
tggaattctctgtgctgtaattta

SEQ ID NO: 233792 - DNA, 24 bp, Artificial sequence
  SiRNA target sequence
ggaattctctgtgctgtaatttat

SEQ ID NO: 233793 - DNA, 24 bp, Artificial sequence
  SiRNA target sequence
gaattctctgtgctgtaatttatc

SEQ ID NO: 233794 - DNA, 24 bp, Artificial sequence
  SiRNA target sequence
aattctctgtgctgtaatttatct

SEQ ID NO: 233795 - DNA, 24 bp, Artificial sequence
  SiRNA target sequence
attctctgtgctgtaatttatctt

SEQ ID NO: 233796 - DNA, 24 bp, Artificial sequence
  SiRNA target sequence
ttctctgtgctgtaatttatcttc

SEQ ID NO: 233797 - DNA, 24 bp, Artificial sequence
  SiRNA target sequence
tctctgtgctgtaatttatcttct

SEQ ID NO: 233798 - DNA, 24 bp, Artificial sequence
  SiRNA target sequence
ctctgtgctgtaatttatcttcta

SEQ ID NO: 233799 - DNA, 24 bp, Artificial sequence
  SiRNA target sequence
tctgtgctgtaatttatcttctaa

SEQ ID NO: 233800 - DNA, 24 bp, Artificial sequence
  SiRNA target sequence
ctgtgctgtaatttatcttctaaa

SEQ ID NO: 233801 - DNA, 24 bp, Artificial sequence
  SiRNA target sequence
tgtgctgtaatttatcttctaaaa

SEQ ID NO: 233802 - DNA, 24 bp, Artificial sequence
  SiRNA target sequence
gtgctgtaatttatcttctaaaaa

SEQ ID NO: 233803 - DNA, 24 bp, Artificial sequence
  SiRNA target sequence
tgctgtaatttatcttctaaaaaa

SEQ ID NO: 233804 - DNA, 24 bp, Artificial sequence
  SiRNA target sequence
gctgtaatttatcttctaaaaaaa

SEQ ID NO: 233805 - DNA, 24 bp, Artificial sequence
  SiRNA target sequence
ctgtaatttatcttctaaaaaaat

SEQ ID NO: 233806 - DNA, 24 bp, Artificial sequence
  SiRNA target sequence
tgtaatttatcttctaaaaaaata

SEQ ID NO: 233807 - DNA, 24 bp, Artificial sequence
  SiRNA target sequence
gtaatttatcttctaaaaaaatat

SEQ ID NO: 233808 - DNA, 24 bp, Artificial sequence
  SiRNA target sequence
taatttatcttctaaaaaaatatt

SEQ ID NO: 233809 - DNA, 24 bp, Artificial sequence
  SiRNA target sequence
aatttatcttctaaaaaaatattt

SEQ ID NO: 233810 - DNA, 24 bp, Artificial sequence
  SiRNA target sequence
atttatcttctaaaaaaatattta

SEQ ID NO: 233811 - DNA, 24 bp, Artificial sequence
  SiRNA target sequence
tttatcttctaaaaaaatatttag

SEQ ID NO: 233812 - DNA, 24 bp, Artificial sequence
  SiRNA target sequence
ttatcttctaaaaaaatatttaga

SEQ ID NO: 233813 - DNA, 24 bp, Artificial sequence
  SiRNA target sequence
tatcttctaaaaaaatatttagaa

SEQ ID NO: 233814 - DNA, 24 bp, Artificial sequence
  SiRNA target sequence
atcttctaaaaaaatatttagaaa

SEQ ID NO: 233815 - DNA, 24 bp, Artificial sequence
  SiRNA target sequence
tcttctaaaaaaatatttagaaaa

SEQ ID NO: 233816 - DNA, 24 bp, Artificial sequence
  SiRNA target sequence
cttctaaaaaaatatttagaaaat

SEQ ID NO: 233817 - DNA, 24 bp, Artificial sequence
  SiRNA target sequence
ttctaaaaaaatatttagaaaata

SEQ ID NO: 233818 - DNA, 24 bp, Artificial sequence
  SiRNA target sequence
tctaaaaaaatatttagaaaataa

SEQ ID NO: 233819 - DNA, 24 bp, Artificial sequence
  SiRNA target sequence
ctaaaaaaatatttagaaaataat

SEQ ID NO: 233820 - DNA, 24 bp, Artificial sequence
  SiRNA target sequence
taaaaaaatatttagaaaataatg

SEQ ID NO: 233821 - DNA, 24 bp, Artificial sequence
  SiRNA target sequence
aaaaaaatatttagaaaataatgt

SEQ ID NO: 233822 - DNA, 24 bp, Artificial sequence
  SiRNA target sequence
aaaaaatatttagaaaataatgtt

SEQ ID NO: 233823 - DNA, 24 bp, Artificial sequence
  SiRNA target sequence
aaaaatatttagaaaataatgtta

SEQ ID NO: 233824 - DNA, 24 bp, Artificial sequence
  SiRNA target sequence
aaaatatttagaaaataatgttac

SEQ ID NO: 233825 - DNA, 24 bp, Artificial sequence
  SiRNA target sequence
aaatatttagaaaataatgttact

SEQ ID NO: 233826 - DNA, 24 bp, Artificial sequence
  SiRNA target sequence
aatatttagaaaataatgttacta

SEQ ID NO: 233827 - DNA, 24 bp, Artificial sequence
  SiRNA target sequence
atatttagaaaataatgttactag

SEQ ID NO: 233828 - DNA, 24 bp, Artificial sequence
  SiRNA target sequence
tatttagaaaataatgttactagc

SEQ ID NO: 233829 - DNA, 24 bp, Artificial sequence
  SiRNA target sequence
atttagaaaataatgttactagca

SEQ ID NO: 233830 - DNA, 24 bp, Artificial sequence
  SiRNA target sequence
tttagaaaataatgttactagcaa

SEQ ID NO: 233831 - DNA, 24 bp, Artificial sequence
  SiRNA target sequence
ttagaaaataatgttactagcaaa

SEQ ID NO: 233832 - DNA, 24 bp, Artificial sequence
  SiRNA target sequence
tagaaaataatgttactagcaaac

SEQ ID NO: 233833 - DNA, 24 bp, Artificial sequence
  SiRNA target sequence
agaaaataatgttactagcaaacc

SEQ ID NO: 233834 - DNA, 24 bp, Artificial sequence
  SiRNA target sequence
gaaaataatgttactagcaaacca

SEQ ID NO: 233835 - DNA, 24 bp, Artificial sequence
  SiRNA target sequence
aaaataatgttactagcaaaccaa

SEQ ID NO: 233836 - DNA, 24 bp, Artificial sequence
  SiRNA target sequence
aaataatgttactagcaaaccaat

SEQ ID NO: 233837 - DNA, 24 bp, Artificial sequence
  SiRNA target sequence
aataatgttactagcaaaccaatg

SEQ ID NO: 233838 - DNA, 24 bp, Artificial sequence
  SiRNA target sequence
ataatgttactagcaaaccaatgt

SEQ ID NO: 233839 - DNA, 24 bp, Artificial sequence
  SiRNA target sequence
taatgttactagcaaaccaatgtt

SEQ ID NO: 233840 - DNA, 24 bp, Artificial sequence
  SiRNA target sequence
aatgttactagcaaaccaatgttt

SEQ ID NO: 233841 - DNA, 24 bp, Artificial sequence
  SiRNA target sequence
atgttactagcaaaccaatgtttg

SEQ ID NO: 233842 - DNA, 24 bp, Artificial sequence
  SiRNA target sequence
tgttactagcaaaccaatgtttgt

SEQ ID NO: 233843 - DNA, 24 bp, Artificial sequence
  SiRNA target sequence
gttactagcaaaccaatgtttgtt

SEQ ID NO: 233844 - DNA, 24 bp, Artificial sequence
  SiRNA target sequence
ttactagcaaaccaatgtttgtta

SEQ ID NO: 233845 - DNA, 24 bp, Artificial sequence
  SiRNA target sequence
tactagcaaaccaatgtttgttag

SEQ ID NO: 233846 - DNA, 24 bp, Artificial sequence
  SiRNA target sequence
actagcaaaccaatgtttgttaga

SEQ ID NO: 233847 - DNA, 24 bp, Artificial sequence
  SiRNA target sequence
ctagcaaaccaatgtttgttagaa

SEQ ID NO: 233848 - DNA, 24 bp, Artificial sequence
  SiRNA target sequence
tagcaaaccaatgtttgttagaaa

SEQ ID NO: 233849 - DNA, 24 bp, Artificial sequence
  SiRNA target sequence
agcaaaccaatgtttgttagaaag

SEQ ID NO: 233850 - DNA, 24 bp, Artificial sequence
  SiRNA target sequence
gcaaaccaatgtttgttagaaaga

SEQ ID NO: 233851 - DNA, 24 bp, Artificial sequence
  SiRNA target sequence
caaaccaatgtttgttagaaagac

SEQ ID NO: 233852 - DNA, 24 bp, Artificial sequence
  SiRNA target sequence
aaaccaatgtttgttagaaagact

SEQ ID NO: 233853 - DNA, 24 bp, Artificial sequence
  SiRNA target sequence
aaccaatgtttgttagaaagactt

SEQ ID NO: 233854 - DNA, 24 bp, Artificial sequence
  SiRNA target sequence
accaatgtttgttagaaagacttt

SEQ ID NO: 233855 - DNA, 24 bp, Artificial sequence
  SiRNA target sequence
ccaatgtttgttagaaagactttt

SEQ ID NO: 233856 - DNA, 24 bp, Artificial sequence
  SiRNA target sequence
caatgtttgttagaaagactttta

SEQ ID NO: 233857 - DNA, 24 bp, Artificial sequence
  SiRNA target sequence
aatgtttgttagaaagacttttac

SEQ ID NO: 233858 - DNA, 24 bp, Artificial sequence
  SiRNA target sequence
atgtttgttagaaagacttttact

SEQ ID NO: 233859 - DNA, 24 bp, Artificial sequence
  SiRNA target sequence
tgtttgttagaaagacttttacta

SEQ ID NO: 233860 - DNA, 24 bp, Artificial sequence
  SiRNA target sequence
gtttgttagaaagacttttactaa

SEQ ID NO: 233861 - DNA, 24 bp, Artificial sequence
  SiRNA target sequence
tttgttagaaagacttttactaaa

SEQ ID NO: 233862 - DNA, 24 bp, Artificial sequence
  SiRNA target sequence
ttgttagaaagacttttactaaaa

SEQ ID NO: 233863 - DNA, 24 bp, Artificial sequence
  SiRNA target sequence
tgttagaaagacttttactaaaaa

SEQ ID NO: 233864 - DNA, 24 bp, Artificial sequence
  SiRNA target sequence
gttagaaagacttttactaaaaag

SEQ ID NO: 233865 - DNA, 24 bp, Artificial sequence
  SiRNA target sequence
ttagaaagacttttactaaaaaga

SEQ ID NO: 233866 - DNA, 24 bp, Artificial sequence
  SiRNA target sequence
tagaaagacttttactaaaaagaa

SEQ ID NO: 233867 - DNA, 24 bp, Artificial sequence
  SiRNA target sequence
agaaagacttttactaaaaagaag

SEQ ID NO: 233868 - DNA, 24 bp, Artificial sequence
  SiRNA target sequence
gaaagacttttactaaaaagaaga

SEQ ID NO: 233869 - DNA, 24 bp, Artificial sequence
  SiRNA target sequence
aaagacttttactaaaaagaagag

SEQ ID NO: 233870 - DNA, 24 bp, Artificial sequence
  SiRNA target sequence
aagacttttactaaaaagaagagt

SEQ ID NO: 233871 - DNA, 24 bp, Artificial sequence
  SiRNA target sequence
agacttttactaaaaagaagagta

SEQ ID NO: 233872 - DNA, 24 bp, Artificial sequence
  SiRNA target sequence
gacttttactaaaaagaagagtaa

SEQ ID NO: 233873 - DNA, 24 bp, Artificial sequence
  SiRNA target sequence
acttttactaaaaagaagagtaaa

SEQ ID NO: 233874 - DNA, 24 bp, Artificial sequence
  SiRNA target sequence
cttttactaaaaagaagagtaaag

SEQ ID NO: 233875 - DNA, 24 bp, Artificial sequence
  SiRNA target sequence
ttttactaaaaagaagagtaaagt

SEQ ID NO: 233876 - DNA, 24 bp, Artificial sequence
  SiRNA target sequence
tttactaaaaagaagagtaaagtg

SEQ ID NO: 233877 - DNA, 24 bp, Artificial sequence
  SiRNA target sequence
ttactaaaaagaagagtaaagtga

SEQ ID NO: 233878 - DNA, 24 bp, Artificial sequence
  SiRNA target sequence
tactaaaaagaagagtaaagtgaa

SEQ ID NO: 233879 - DNA, 24 bp, Artificial sequence
  SiRNA target sequence
actaaaaagaagagtaaagtgaag

SEQ ID NO: 233880 - DNA, 24 bp, Artificial sequence
  SiRNA target sequence
ctaaaaagaagagtaaagtgaagg

SEQ ID NO: 233881 - DNA, 24 bp, Artificial sequence
  SiRNA target sequence
taaaaagaagagtaaagtgaaggt

SEQ ID NO: 233882 - DNA, 24 bp, Artificial sequence
  SiRNA target sequence
aaaaagaagagtaaagtgaaggtt

SEQ ID NO: 233883 - DNA, 24 bp, Artificial sequence
  SiRNA target sequence
aaaagaagagtaaagtgaaggttg

SEQ ID NO: 233884 - DNA, 24 bp, Artificial sequence
  SiRNA target sequence
aaagaagagtaaagtgaaggttgg

SEQ ID NO: 233885 - DNA, 24 bp, Artificial sequence
  SiRNA target sequence
aagaagagtaaagtgaaggttgga

SEQ ID NO: 233886 - DNA, 24 bp, Artificial sequence
  SiRNA target sequence
agaagagtaaagtgaaggttggat

SEQ ID NO: 233887 - DNA, 24 bp, Artificial sequence
  SiRNA target sequence
gaagagtaaagtgaaggttggatt

SEQ ID NO: 233888 - DNA, 24 bp, Artificial sequence
  SiRNA target sequence
aagagtaaagtgaaggttggattt

SEQ ID NO: 233889 - DNA, 24 bp, Artificial sequence
  SiRNA target sequence
agagtaaagtgaaggttggatttg

SEQ ID NO: 233890 - DNA, 24 bp, Artificial sequence
  SiRNA target sequence
gagtaaagtgaaggttggatttgt

SEQ ID NO: 233891 - DNA, 24 bp, Artificial sequence
  SiRNA target sequence
agtaaagtgaaggttggatttgtt

SEQ ID NO: 233892 - DNA, 24 bp, Artificial sequence
  SiRNA target sequence
gtaaagtgaaggttggatttgttg

SEQ ID NO: 233893 - DNA, 24 bp, Artificial sequence
  SiRNA target sequence
taaagtgaaggttggatttgttga

SEQ ID NO: 233894 - DNA, 24 bp, Artificial sequence
  SiRNA target sequence
aaagtgaaggttggatttgttgat

SEQ ID NO: 233895 - DNA, 24 bp, Artificial sequence
  SiRNA target sequence
aagtgaaggttggatttgttgatg

SEQ ID NO: 233896 - DNA, 24 bp, Artificial sequence
  SiRNA target sequence
agtgaaggttggatttgttgatgg

SEQ ID NO: 233897 - DNA, 24 bp, Artificial sequence
  SiRNA target sequence
gtgaaggttggatttgttgatgga

SEQ ID NO: 233898 - DNA, 24 bp, Artificial sequence
  SiRNA target sequence
tgaaggttggatttgttgatggac

SEQ ID NO: 233899 - DNA, 24 bp, Artificial sequence
  SiRNA target sequence
gaaggttggatttgttgatggact

SEQ ID NO: 233900 - DNA, 24 bp, Artificial sequence
  SiRNA target sequence
aaggttggatttgttgatggactt

SEQ ID NO: 233901 - DNA, 24 bp, Artificial sequence
  SiRNA target sequence
aggttggatttgttgatggactta

SEQ ID NO: 233902 - DNA, 24 bp, Artificial sequence
  SiRNA target sequence
ggttggatttgttgatggacttat

SEQ ID NO: 233903 - DNA, 24 bp, Artificial sequence
  SiRNA target sequence
gttggatttgttgatggacttatt

SEQ ID NO: 233904 - DNA, 24 bp, Artificial sequence
  SiRNA target sequence
ttggatttgttgatggacttattg

SEQ ID NO: 233905 - DNA, 24 bp, Artificial sequence
  SiRNA target sequence
tggatttgttgatggacttattga

SEQ ID NO: 233906 - DNA, 24 bp, Artificial sequence
  SiRNA target sequence
ggatttgttgatggacttattgag

SEQ ID NO: 233907 - DNA, 24 bp, Artificial sequence
  SiRNA target sequence
gatttgttgatggacttattgaga

SEQ ID NO: 233908 - DNA, 24 bp, Artificial sequence
  SiRNA target sequence
atttgttgatggacttattgagat

SEQ ID NO: 233909 - DNA, 24 bp, Artificial sequence
  SiRNA target sequence
tttgttgatggacttattgagatg

SEQ ID NO: 233910 - DNA, 24 bp, Artificial sequence
  SiRNA target sequence
ttgttgatggacttattgagatga

SEQ ID NO: 233911 - DNA, 24 bp, Artificial sequence
  SiRNA target sequence
tgttgatggacttattgagatgag

SEQ ID NO: 233912 - DNA, 24 bp, Artificial sequence
  SiRNA target sequence
gttgatggacttattgagatgagt

SEQ ID NO: 233913 - DNA, 24 bp, Artificial sequence
  SiRNA target sequence
ttgatggacttattgagatgagta

SEQ ID NO: 233914 - DNA, 24 bp, Artificial sequence
  SiRNA target sequence
tgatggacttattgagatgagtaa

SEQ ID NO: 233915 - DNA, 24 bp, Artificial sequence
  SiRNA target sequence
gatggacttattgagatgagtaaa

SEQ ID NO: 233916 - DNA, 24 bp, Artificial sequence
  SiRNA target sequence
atggacttattgagatgagtaaat

SEQ ID NO: 233917 - DNA, 24 bp, Artificial sequence
  SiRNA target sequence
tggacttattgagatgagtaaatc

SEQ ID NO: 233918 - DNA, 24 bp, Artificial sequence
  SiRNA target sequence
ggacttattgagatgagtaaatct

SEQ ID NO: 233919 - DNA, 24 bp, Artificial sequence
  SiRNA target sequence
gacttattgagatgagtaaatcta

SEQ ID NO: 233920 - DNA, 24 bp, Artificial sequence
  SiRNA target sequence
acttattgagatgagtaaatctaa

SEQ ID NO: 233921 - DNA, 24 bp, Artificial sequence
  SiRNA target sequence
cttattgagatgagtaaatctaaa

SEQ ID NO: 233922 - DNA, 24 bp, Artificial sequence
  SiRNA target sequence
ttattgagatgagtaaatctaaac

SEQ ID NO: 233923 - DNA, 24 bp, Artificial sequence
  SiRNA target sequence
tattgagatgagtaaatctaaact

SEQ ID NO: 233924 - DNA, 24 bp, Artificial sequence
  SiRNA target sequence
attgagatgagtaaatctaaacta

SEQ ID NO: 233925 - DNA, 24 bp, Artificial sequence
  SiRNA target sequence
ttgagatgagtaaatctaaactac

SEQ ID NO: 233926 - DNA, 24 bp, Artificial sequence
  SiRNA target sequence
tgagatgagtaaatctaaactact

SEQ ID NO: 233927 - DNA, 24 bp, Artificial sequence
  SiRNA target sequence
gagatgagtaaatctaaactactg

SEQ ID NO: 233928 - DNA, 24 bp, Artificial sequence
  SiRNA target sequence
agatgagtaaatctaaactactgt

SEQ ID NO: 233929 - DNA, 24 bp, Artificial sequence
  SiRNA target sequence
gatgagtaaatctaaactactgtt

SEQ ID NO: 233930 - DNA, 24 bp, Artificial sequence
  SiRNA target sequence
atgagtaaatctaaactactgttg

SEQ ID NO: 233931 - DNA, 24 bp, Artificial sequence
  SiRNA target sequence
tgagtaaatctaaactactgttga

SEQ ID NO: 233932 - DNA, 24 bp, Artificial sequence
  SiRNA target sequence
gagtaaatctaaactactgttgaa

SEQ ID NO: 233933 - DNA, 24 bp, Artificial sequence
  SiRNA target sequence
agtaaatctaaactactgttgaat

SEQ ID NO: 233934 - DNA, 24 bp, Artificial sequence
  SiRNA target sequence
gtaaatctaaactactgttgaata

SEQ ID NO: 233935 - DNA, 24 bp, Artificial sequence
  SiRNA target sequence
taaatctaaactactgttgaatat

SEQ ID NO: 233936 - DNA, 24 bp, Artificial sequence
  SiRNA target sequence
aaatctaaactactgttgaatatg

SEQ ID NO: 233937 - DNA, 24 bp, Artificial sequence
  SiRNA target sequence
aatctaaactactgttgaatatgt

SEQ ID NO: 233938 - DNA, 24 bp, Artificial sequence
  SiRNA target sequence
atctaaactactgttgaatatgtc

SEQ ID NO: 233939 - DNA, 24 bp, Artificial sequence
  SiRNA target sequence
tctaaactactgttgaatatgtca

SEQ ID NO: 233940 - DNA, 24 bp, Artificial sequence
  SiRNA target sequence
ctaaactactgttgaatatgtcat

SEQ ID NO: 233941 - DNA, 24 bp, Artificial sequence
  SiRNA target sequence
taaactactgttgaatatgtcatt

SEQ ID NO: 233942 - DNA, 24 bp, Artificial sequence
  SiRNA target sequence
aaactactgttgaatatgtcatta

SEQ ID NO: 233943 - DNA, 24 bp, Artificial sequence
  SiRNA target sequence
aactactgttgaatatgtcattag

SEQ ID NO: 233944 - DNA, 24 bp, Artificial sequence
  SiRNA target sequence
actactgttgaatatgtcattagt

SEQ ID NO: 233945 - DNA, 24 bp, Artificial sequence
  SiRNA target sequence
ctactgttgaatatgtcattagtc

SEQ ID NO: 233946 - DNA, 24 bp, Artificial sequence
  SiRNA target sequence
tactgttgaatatgtcattagtcg

SEQ ID NO: 233947 - DNA, 24 bp, Artificial sequence
  SiRNA target sequence
actgttgaatatgtcattagtcgt

SEQ ID NO: 233948 - DNA, 24 bp, Artificial sequence
  SiRNA target sequence
ctgttgaatatgtcattagtcgta

SEQ ID NO: 233949 - DNA, 24 bp, Artificial sequence
  SiRNA target sequence
tgttgaatatgtcattagtcgtat

SEQ ID NO: 233950 - DNA, 24 bp, Artificial sequence
  SiRNA target sequence
gttgaatatgtcattagtcgtatt

SEQ ID NO: 233951 - DNA, 24 bp, Artificial sequence
  SiRNA target sequence
ttgaatatgtcattagtcgtatta

SEQ ID NO: 233952 - DNA, 24 bp, Artificial sequence
  SiRNA target sequence
tgaatatgtcattagtcgtattat

SEQ ID NO: 233953 - DNA, 24 bp, Artificial sequence
  SiRNA target sequence
gaatatgtcattagtcgtattatt

SEQ ID NO: 233954 - DNA, 24 bp, Artificial sequence
  SiRNA target sequence
aatatgtcattagtcgtattattt

SEQ ID NO: 233955 - DNA, 24 bp, Artificial sequence
  SiRNA target sequence
atatgtcattagtcgtattatttt

SEQ ID NO: 233956 - DNA, 24 bp, Artificial sequence
  SiRNA target sequence
tatgtcattagtcgtattatttta

SEQ ID NO: 233957 - DNA, 24 bp, Artificial sequence
  SiRNA target sequence
atgtcattagtcgtattattttat

SEQ ID NO: 233958 - DNA, 24 bp, Artificial sequence
  SiRNA target sequence
tgtcattagtcgtattattttatg

SEQ ID NO: 233959 - DNA, 24 bp, Artificial sequence
  SiRNA target sequence
gtcattagtcgtattattttatgc

SEQ ID NO: 233960 - DNA, 24 bp, Artificial sequence
  SiRNA target sequence
tcattagtcgtattattttatgct

SEQ ID NO: 233961 - DNA, 24 bp, Artificial sequence
  SiRNA target sequence
cattagtcgtattattttatgctg

SEQ ID NO: 233962 - DNA, 24 bp, Artificial sequence
  SiRNA target sequence
attagtcgtattattttatgctgt

SEQ ID NO: 233963 - DNA, 24 bp, Artificial sequence
  SiRNA target sequence
ttagtcgtattattttatgctgtt

SEQ ID NO: 233964 - DNA, 24 bp, Artificial sequence
  SiRNA target sequence
tagtcgtattattttatgctgttt

SEQ ID NO: 233965 - DNA, 24 bp, Artificial sequence
  SiRNA target sequence
agtcgtattattttatgctgtttc

SEQ ID NO: 233966 - DNA, 24 bp, Artificial sequence
  SiRNA target sequence
gtcgtattattttatgctgtttct

SEQ ID NO: 233967 - DNA, 24 bp, Artificial sequence
  SiRNA target sequence
tcgtattattttatgctgtttcta

SEQ ID NO: 233968 - DNA, 24 bp, Artificial sequence
  SiRNA target sequence
cgtattattttatgctgtttctac

SEQ ID NO: 233969 - DNA, 24 bp, Artificial sequence
  SiRNA target sequence
gtattattttatgctgtttctacg

SEQ ID NO: 233970 - DNA, 24 bp, Artificial sequence
  SiRNA target sequence
tattattttatgctgtttctacga

SEQ ID NO: 233971 - DNA, 24 bp, Artificial sequence
  SiRNA target sequence
attattttatgctgtttctacgaa

SEQ ID NO: 233972 - DNA, 24 bp, Artificial sequence
  SiRNA target sequence
ttattttatgctgtttctacgaat

SEQ ID NO: 233973 - DNA, 24 bp, Artificial sequence
  SiRNA target sequence
tattttatgctgtttctacgaata

SEQ ID NO: 233974 - DNA, 24 bp, Artificial sequence
  SiRNA target sequence
attttatgctgtttctacgaatat

SEQ ID NO: 233975 - DNA, 24 bp, Artificial sequence
  SiRNA target sequence
ttttatgctgtttctacgaatatt

SEQ ID NO: 233976 - DNA, 24 bp, Artificial sequence
  SiRNA target sequence
tttatgctgtttctacgaatatta

SEQ ID NO: 233977 - DNA, 24 bp, Artificial sequence
  SiRNA target sequence
ttatgctgtttctacgaatattat

SEQ ID NO: 233978 - DNA, 24 bp, Artificial sequence
  SiRNA target sequence
tatgctgtttctacgaatattatt

SEQ ID NO: 233979 - DNA, 24 bp, Artificial sequence
  SiRNA target sequence
atgctgtttctacgaatattattg

SEQ ID NO: 233980 - DNA, 24 bp, Artificial sequence
  SiRNA target sequence
tgctgtttctacgaatattattga

SEQ ID NO: 233981 - DNA, 24 bp, Artificial sequence
  SiRNA target sequence
gctgtttctacgaatattattgag

SEQ ID NO: 233982 - DNA, 24 bp, Artificial sequence
  SiRNA target sequence
ctgtttctacgaatattattgagt

SEQ ID NO: 233983 - DNA, 24 bp, Artificial sequence
  SiRNA target sequence
tgtttctacgaatattattgagtc

SEQ ID NO: 233984 - DNA, 24 bp, Artificial sequence
  SiRNA target sequence
gtttctacgaatattattgagtca

SEQ ID NO: 233985 - DNA, 24 bp, Artificial sequence
  SiRNA target sequence
tttctacgaatattattgagtcag

SEQ ID NO: 233986 - DNA, 24 bp, Artificial sequence
  SiRNA target sequence
ttctacgaatattattgagtcagc

SEQ ID NO: 233987 - DNA, 24 bp, Artificial sequence
  SiRNA target sequence
tctacgaatattattgagtcagct

SEQ ID NO: 233988 - DNA, 24 bp, Artificial sequence
  SiRNA target sequence
ctacgaatattattgagtcagctt

SEQ ID NO: 233989 - DNA, 24 bp, Artificial sequence
  SiRNA target sequence
tacgaatattattgagtcagctta

SEQ ID NO: 233990 - DNA, 24 bp, Artificial sequence
  SiRNA target sequence
acgaatattattgagtcagcttat

SEQ ID NO: 233991 - DNA, 24 bp, Artificial sequence
  SiRNA target sequence
cgaatattattgagtcagcttata

SEQ ID NO: 233992 - DNA, 24 bp, Artificial sequence
  SiRNA target sequence
gaatattattgagtcagcttataa

SEQ ID NO: 233993 - DNA, 24 bp, Artificial sequence
  SiRNA target sequence
aatattattgagtcagcttataaa

SEQ ID NO: 233994 - DNA, 24 bp, Artificial sequence
  SiRNA target sequence
atattattgagtcagcttataaat

SEQ ID NO: 233995 - DNA, 24 bp, Artificial sequence
  SiRNA target sequence
tattattgagtcagcttataaatc

SEQ ID NO: 233996 - DNA, 24 bp, Artificial sequence
  SiRNA target sequence
attattgagtcagcttataaatct

SEQ ID NO: 233997 - DNA, 24 bp, Artificial sequence
  SiRNA target sequence
ttattgagtcagcttataaatctg

SEQ ID NO: 233998 - DNA, 24 bp, Artificial sequence
  SiRNA target sequence
tattgagtcagcttataaatctgc

SEQ ID NO: 233999 - DNA, 24 bp, Artificial sequence
  SiRNA target sequence
attgagtcagcttataaatctgct

SEQ ID NO: 234000 - DNA, 24 bp, Artificial sequence
  SiRNA target sequence
ttgagtcagcttataaatctgctt

SEQ ID NO: 234001 - DNA, 24 bp, Artificial sequence
  SiRNA target sequence
tgagtcagcttataaatctgcttt

SEQ ID NO: 234002 - DNA, 24 bp, Artificial sequence
  SiRNA target sequence
gagtcagcttataaatctgcttta

SEQ ID NO: 234003 - DNA, 24 bp, Artificial sequence
  SiRNA target sequence
agtcagcttataaatctgctttag

SEQ ID NO: 234004 - DNA, 24 bp, Artificial sequence
  SiRNA target sequence
gtcagcttataaatctgctttagc

SEQ ID NO: 234005 - DNA, 24 bp, Artificial sequence
  SiRNA target sequence
tcagcttataaatctgctttagct

SEQ ID NO: 234006 - DNA, 24 bp, Artificial sequence
  SiRNA target sequence
cagcttataaatctgctttagctg

SEQ ID NO: 234007 - DNA, 24 bp, Artificial sequence
  SiRNA target sequence
agcttataaatctgctttagctgt

SEQ ID NO: 234008 - DNA, 24 bp, Artificial sequence
  SiRNA target sequence
gcttataaatctgctttagctgtc

SEQ ID NO: 234009 - DNA, 24 bp, Artificial sequence
  SiRNA target sequence
cttataaatctgctttagctgtcg

SEQ ID NO: 234010 - DNA, 24 bp, Artificial sequence
  SiRNA target sequence
ttataaatctgctttagctgtcgg

SEQ ID NO: 234011 - DNA, 24 bp, Artificial sequence
  SiRNA target sequence
tataaatctgctttagctgtcggt

SEQ ID NO: 234012 - DNA, 24 bp, Artificial sequence
  SiRNA target sequence
ataaatctgctttagctgtcggtg

SEQ ID NO: 234013 - DNA, 24 bp, Artificial sequence
  SiRNA target sequence
taaatctgctttagctgtcggtgc

SEQ ID NO: 234014 - DNA, 24 bp, Artificial sequence
  SiRNA target sequence
aaatctgctttagctgtcggtgct

SEQ ID NO: 234015 - DNA, 24 bp, Artificial sequence
  SiRNA target sequence
aatctgctttagctgtcggtgcta

SEQ ID NO: 234016 - DNA, 24 bp, Artificial sequence
  SiRNA target sequence
atctgctttagctgtcggtgctaa

SEQ ID NO: 234017 - DNA, 24 bp, Artificial sequence
  SiRNA target sequence
tctgctttagctgtcggtgctaat

SEQ ID NO: 234018 - DNA, 24 bp, Artificial sequence
  SiRNA target sequence
ctgctttagctgtcggtgctaatg

SEQ ID NO: 234019 - DNA, 24 bp, Artificial sequence
  SiRNA target sequence
tgctttagctgtcggtgctaatga

SEQ ID NO: 234020 - DNA, 24 bp, Artificial sequence
  SiRNA target sequence
gctttagctgtcggtgctaatgaa

SEQ ID NO: 234021 - DNA, 24 bp, Artificial sequence
  SiRNA target sequence
ctttagctgtcggtgctaatgaaa

SEQ ID NO: 234022 - DNA, 24 bp, Artificial sequence
  SiRNA target sequence
tttagctgtcggtgctaatgaaac

SEQ ID NO: 234023 - DNA, 24 bp, Artificial sequence
  SiRNA target sequence
ttagctgtcggtgctaatgaaact

SEQ ID NO: 234024 - DNA, 24 bp, Artificial sequence
  SiRNA target sequence
tagctgtcggtgctaatgaaactg

SEQ ID NO: 234025 - DNA, 24 bp, Artificial sequence
  SiRNA target sequence
agctgtcggtgctaatgaaactgg

SEQ ID NO: 234026 - DNA, 24 bp, Artificial sequence
  SiRNA target sequence
gctgtcggtgctaatgaaactggt

SEQ ID NO: 234027 - DNA, 24 bp, Artificial sequence
  SiRNA target sequence
ctgtcggtgctaatgaaactggtg

SEQ ID NO: 234028 - DNA, 24 bp, Artificial sequence
  SiRNA target sequence
tgtcggtgctaatgaaactggtga

SEQ ID NO: 234029 - DNA, 24 bp, Artificial sequence
  SiRNA target sequence
gtcggtgctaatgaaactggtgag

SEQ ID NO: 234030 - DNA, 24 bp, Artificial sequence
  SiRNA target sequence
tcggtgctaatgaaactggtgagg

SEQ ID NO: 234031 - DNA, 24 bp, Artificial sequence
  SiRNA target sequence
cggtgctaatgaaactggtgaggc

SEQ ID NO: 234032 - DNA, 24 bp, Artificial sequence
  SiRNA target sequence
ggtgctaatgaaactggtgaggca

SEQ ID NO: 234033 - DNA, 24 bp, Artificial sequence
  SiRNA target sequence
gtgctaatgaaactggtgaggcaa

SEQ ID NO: 234034 - DNA, 24 bp, Artificial sequence
  SiRNA target sequence
tgctaatgaaactggtgaggcaaa

SEQ ID NO: 234035 - DNA, 24 bp, Artificial sequence
  SiRNA target sequence
gctaatgaaactggtgaggcaaaa

SEQ ID NO: 234036 - DNA, 24 bp, Artificial sequence
  SiRNA target sequence
ctaatgaaactggtgaggcaaaat

SEQ ID NO: 234037 - DNA, 24 bp, Artificial sequence
  SiRNA target sequence
taatgaaactggtgaggcaaaatc

SEQ ID NO: 234038 - DNA, 24 bp, Artificial sequence
  SiRNA target sequence
aatgaaactggtgaggcaaaatct

SEQ ID NO: 234039 - DNA, 24 bp, Artificial sequence
  SiRNA target sequence
atgaaactggtgaggcaaaatcta

SEQ ID NO: 234040 - DNA, 24 bp, Artificial sequence
  SiRNA target sequence
tgaaactggtgaggcaaaatctac

SEQ ID NO: 234041 - DNA, 24 bp, Artificial sequence
  SiRNA target sequence
gaaactggtgaggcaaaatctacc

SEQ ID NO: 234042 - DNA, 24 bp, Artificial sequence
  SiRNA target sequence
aaactggtgaggcaaaatctacct

SEQ ID NO: 234043 - DNA, 24 bp, Artificial sequence
  SiRNA target sequence
aactggtgaggcaaaatctaccta

SEQ ID NO: 234044 - DNA, 24 bp, Artificial sequence
  SiRNA target sequence
actggtgaggcaaaatctacctat

SEQ ID NO: 234045 - DNA, 24 bp, Artificial sequence
  SiRNA target sequence
ctggtgaggcaaaatctacctatg

SEQ ID NO: 234046 - DNA, 24 bp, Artificial sequence
  SiRNA target sequence
tggtgaggcaaaatctacctatgc

SEQ ID NO: 234047 - DNA, 24 bp, Artificial sequence
  SiRNA target sequence
ggtgaggcaaaatctacctatgct

SEQ ID NO: 234048 - DNA, 24 bp, Artificial sequence
  SiRNA target sequence
gtgaggcaaaatctacctatgctt

SEQ ID NO: 234049 - DNA, 24 bp, Artificial sequence
  SiRNA target sequence
tgaggcaaaatctacctatgcttc

SEQ ID NO: 234050 - DNA, 24 bp, Artificial sequence
  SiRNA target sequence
gaggcaaaatctacctatgcttca

SEQ ID NO: 234051 - DNA, 24 bp, Artificial sequence
  SiRNA target sequence
aggcaaaatctacctatgcttcaa

SEQ ID NO: 234052 - DNA, 24 bp, Artificial sequence
  SiRNA target sequence
ggcaaaatctacctatgcttcaat

SEQ ID NO: 234053 - DNA, 24 bp, Artificial sequence
  SiRNA target sequence
gcaaaatctacctatgcttcaatt

SEQ ID NO: 234054 - DNA, 24 bp, Artificial sequence
  SiRNA target sequence
caaaatctacctatgcttcaattt

SEQ ID NO: 234055 - DNA, 24 bp, Artificial sequence
  SiRNA target sequence
aaaatctacctatgcttcaattta

SEQ ID NO: 234056 - DNA, 24 bp, Artificial sequence
  SiRNA target sequence
aaatctacctatgcttcaatttat

SEQ ID NO: 234057 - DNA, 24 bp, Artificial sequence
  SiRNA target sequence
aatctacctatgcttcaatttata

SEQ ID NO: 234058 - DNA, 24 bp, Artificial sequence
  SiRNA target sequence
atctacctatgcttcaatttatac

SEQ ID NO: 234059 - DNA, 24 bp, Artificial sequence
  SiRNA target sequence
tctacctatgcttcaatttataca

SEQ ID NO: 234060 - DNA, 24 bp, Artificial sequence
  SiRNA target sequence
ctacctatgcttcaatttatacat

SEQ ID NO: 234061 - DNA, 24 bp, Artificial sequence
  SiRNA target sequence
tacctatgcttcaatttatacatc

SEQ ID NO: 234062 - DNA, 24 bp, Artificial sequence
  SiRNA target sequence
acctatgcttcaatttatacatca

SEQ ID NO: 234063 - DNA, 24 bp, Artificial sequence
  SiRNA target sequence
cctatgcttcaatttatacatcaa

SEQ ID NO: 234064 - DNA, 24 bp, Artificial sequence
  SiRNA target sequence
ctatgcttcaatttatacatcaat

SEQ ID NO: 234065 - DNA, 24 bp, Artificial sequence
  SiRNA target sequence
tatgcttcaatttatacatcaatt

SEQ ID NO: 234066 - DNA, 24 bp, Artificial sequence
  SiRNA target sequence
atgcttcaatttatacatcaattg

SEQ ID NO: 234067 - DNA, 24 bp, Artificial sequence
  SiRNA target sequence
tgcttcaatttatacatcaattga

SEQ ID NO: 234068 - DNA, 24 bp, Artificial sequence
  SiRNA target sequence
gcttcaatttatacatcaattgaa

SEQ ID NO: 234069 - DNA, 24 bp, Artificial sequence
  SiRNA target sequence
cttcaatttatacatcaattgaac

SEQ ID NO: 234070 - DNA, 24 bp, Artificial sequence
  SiRNA target sequence
ttcaatttatacatcaattgaaca

SEQ ID NO: 234071 - DNA, 24 bp, Artificial sequence
  SiRNA target sequence
tcaatttatacatcaattgaacaa

SEQ ID NO: 234072 - DNA, 24 bp, Artificial sequence
  SiRNA target sequence
caatttatacatcaattgaacaat

SEQ ID NO: 234073 - DNA, 24 bp, Artificial sequence
  SiRNA target sequence
aatttatacatcaattgaacaatc

SEQ ID NO: 234074 - DNA, 24 bp, Artificial sequence
  SiRNA target sequence
atttatacatcaattgaacaatct

SEQ ID NO: 234075 - DNA, 24 bp, Artificial sequence
  SiRNA target sequence
tttatacatcaattgaacaatctg

SEQ ID NO: 234076 - DNA, 24 bp, Artificial sequence
  SiRNA target sequence
ttatacatcaattgaacaatctgg

SEQ ID NO: 234077 - DNA, 24 bp, Artificial sequence
  SiRNA target sequence
tatacatcaattgaacaatctgga

SEQ ID NO: 234078 - DNA, 24 bp, Artificial sequence
  SiRNA target sequence
atacatcaattgaacaatctggag

SEQ ID NO: 234079 - DNA, 24 bp, Artificial sequence
  SiRNA target sequence
tacatcaattgaacaatctggagt

SEQ ID NO: 234080 - DNA, 24 bp, Artificial sequence
  SiRNA target sequence
acatcaattgaacaatctggagtt

SEQ ID NO: 234081 - DNA, 24 bp, Artificial sequence
  SiRNA target sequence
catcaattgaacaatctggagttg

SEQ ID NO: 234082 - DNA, 24 bp, Artificial sequence
  SiRNA target sequence
atcaattgaacaatctggagttgc

SEQ ID NO: 234083 - DNA, 24 bp, Artificial sequence
  SiRNA target sequence
tcaattgaacaatctggagttgct

SEQ ID NO: 234084 - DNA, 24 bp, Artificial sequence
  SiRNA target sequence
caattgaacaatctggagttgctg

SEQ ID NO: 234085 - DNA, 24 bp, Artificial sequence
  SiRNA target sequence
aattgaacaatctggagttgctgt

SEQ ID NO: 234086 - DNA, 24 bp, Artificial sequence
  SiRNA target sequence
attgaacaatctggagttgctgtt

SEQ ID NO: 234087 - DNA, 24 bp, Artificial sequence
  SiRNA target sequence
ttgaacaatctggagttgctgtta

SEQ ID NO: 234088 - DNA, 24 bp, Artificial sequence
  SiRNA target sequence
tgaacaatctggagttgctgttat

SEQ ID NO: 234089 - DNA, 24 bp, Artificial sequence
  SiRNA target sequence
gaacaatctggagttgctgttatt

SEQ ID NO: 234090 - DNA, 24 bp, Artificial sequence
  SiRNA target sequence
aacaatctggagttgctgttattg

SEQ ID NO: 234091 - DNA, 24 bp, Artificial sequence
  SiRNA target sequence
acaatctggagttgctgttattgt

SEQ ID NO: 234092 - DNA, 24 bp, Artificial sequence
  SiRNA target sequence
caatctggagttgctgttattgtc

SEQ ID NO: 234093 - DNA, 24 bp, Artificial sequence
  SiRNA target sequence
aatctggagttgctgttattgtca

SEQ ID NO: 234094 - DNA, 24 bp, Artificial sequence
  SiRNA target sequence
atctggagttgctgttattgtcat

SEQ ID NO: 234095 - DNA, 24 bp, Artificial sequence
  SiRNA target sequence
tctggagttgctgttattgtcatg

SEQ ID NO: 234096 - DNA, 24 bp, Artificial sequence
  SiRNA target sequence
ctggagttgctgttattgtcatga

SEQ ID NO: 234097 - DNA, 24 bp, Artificial sequence
  SiRNA target sequence
tggagttgctgttattgtcatgat

SEQ ID NO: 234098 - DNA, 24 bp, Artificial sequence
  SiRNA target sequence
ggagttgctgttattgtcatgatt

SEQ ID NO: 234099 - DNA, 24 bp, Artificial sequence
  SiRNA target sequence
gagttgctgttattgtcatgattt

SEQ ID NO: 234100 - DNA, 24 bp, Artificial sequence
  SiRNA target sequence
agttgctgttattgtcatgatttt

SEQ ID NO: 234101 - DNA, 24 bp, Artificial sequence
  SiRNA target sequence
gttgctgttattgtcatgattttg

SEQ ID NO: 234102 - DNA, 24 bp, Artificial sequence
  SiRNA target sequence
ttgctgttattgtcatgattttgc

SEQ ID NO: 234103 - DNA, 24 bp, Artificial sequence
  SiRNA target sequence
tgctgttattgtcatgattttgct

SEQ ID NO: 234104 - DNA, 24 bp, Artificial sequence
  SiRNA target sequence
gctgttattgtcatgattttgcta

SEQ ID NO: 234105 - DNA, 24 bp, Artificial sequence
  SiRNA target sequence
ctgttattgtcatgattttgctac

SEQ ID NO: 234106 - DNA, 24 bp, Artificial sequence
  SiRNA target sequence
tgttattgtcatgattttgctact

SEQ ID NO: 234107 - DNA, 24 bp, Artificial sequence
  SiRNA target sequence
gttattgtcatgattttgctactt

SEQ ID NO: 234108 - DNA, 24 bp, Artificial sequence
  SiRNA target sequence
ttattgtcatgattttgctactta

SEQ ID NO: 234109 - DNA, 24 bp, Artificial sequence
  SiRNA target sequence
tattgtcatgattttgctacttac

SEQ ID NO: 234110 - DNA, 24 bp, Artificial sequence
  SiRNA target sequence
attgtcatgattttgctacttacc

SEQ ID NO: 234111 - DNA, 24 bp, Artificial sequence
  SiRNA target sequence
ttgtcatgattttgctacttaccc

SEQ ID NO: 234112 - DNA, 24 bp, Artificial sequence
  SiRNA target sequence
tgtcatgattttgctacttacccc

SEQ ID NO: 234113 - DNA, 24 bp, Artificial sequence
  SiRNA target sequence
gtcatgattttgctacttacccct

SEQ ID NO: 234114 - DNA, 24 bp, Artificial sequence
  SiRNA target sequence
tcatgattttgctacttacccctt

SEQ ID NO: 234115 - DNA, 24 bp, Artificial sequence
  SiRNA target sequence
catgattttgctacttaccccttt

SEQ ID NO: 234116 - DNA, 24 bp, Artificial sequence
  SiRNA target sequence
atgattttgctacttacccctttt

SEQ ID NO: 234117 - DNA, 24 bp, Artificial sequence
  SiRNA target sequence
tgattttgctacttaccccttttc

SEQ ID NO: 234118 - DNA, 24 bp, Artificial sequence
  SiRNA target sequence
gattttgctacttaccccttttcc

SEQ ID NO: 234119 - DNA, 24 bp, Artificial sequence
  SiRNA target sequence
attttgctacttaccccttttcca

SEQ ID NO: 234120 - DNA, 24 bp, Artificial sequence
  SiRNA target sequence
ttttgctacttaccccttttccaa

SEQ ID NO: 234121 - DNA, 24 bp, Artificial sequence
  SiRNA target sequence
tttgctacttaccccttttccaag

SEQ ID NO: 234122 - DNA, 24 bp, Artificial sequence
  SiRNA target sequence
ttgctacttaccccttttccaagg

SEQ ID NO: 234123 - DNA, 24 bp, Artificial sequence
  SiRNA target sequence
tgctacttaccccttttccaaggc

SEQ ID NO: 234124 - DNA, 24 bp, Artificial sequence
  SiRNA target sequence
gctacttaccccttttccaaggct

SEQ ID NO: 234125 - DNA, 24 bp, Artificial sequence
  SiRNA target sequence
ctacttaccccttttccaaggctt

SEQ ID NO: 234126 - DNA, 24 bp, Artificial sequence
  SiRNA target sequence
tacttaccccttttccaaggctta

SEQ ID NO: 234127 - DNA, 24 bp, Artificial sequence
  SiRNA target sequence
acttaccccttttccaaggcttat

SEQ ID NO: 234128 - DNA, 24 bp, Artificial sequence
  SiRNA target sequence
cttaccccttttccaaggcttatt

SEQ ID NO: 234129 - DNA, 24 bp, Artificial sequence
  SiRNA target sequence
ttaccccttttccaaggcttatta

SEQ ID NO: 234130 - DNA, 24 bp, Artificial sequence
  SiRNA target sequence
taccccttttccaaggcttattaa

SEQ ID NO: 234131 - DNA, 24 bp, Artificial sequence
  SiRNA target sequence
accccttttccaaggcttattaaa

SEQ ID NO: 234132 - DNA, 24 bp, Artificial sequence
  SiRNA target sequence
ccccttttccaaggcttattaaaa

SEQ ID NO: 234133 - DNA, 24 bp, Artificial sequence
  SiRNA target sequence
cccttttccaaggcttattaaaac

SEQ ID NO: 234134 - DNA, 24 bp, Artificial sequence
  SiRNA target sequence
ccttttccaaggcttattaaaaca

SEQ ID NO: 234135 - DNA, 24 bp, Artificial sequence
  SiRNA target sequence
cttttccaaggcttattaaaacaa

SEQ ID NO: 234136 - DNA, 24 bp, Artificial sequence
  SiRNA target sequence
ttttccaaggcttattaaaacaaa

SEQ ID NO: 234137 - DNA, 24 bp, Artificial sequence
  SiRNA target sequence
tttccaaggcttattaaaacaaaa

SEQ ID NO: 234138 - DNA, 24 bp, Artificial sequence
  SiRNA target sequence
ttccaaggcttattaaaacaaaag

SEQ ID NO: 234139 - DNA, 24 bp, Artificial sequence
  SiRNA target sequence
tccaaggcttattaaaacaaaagg

SEQ ID NO: 234140 - DNA, 24 bp, Artificial sequence
  SiRNA target sequence
ccaaggcttattaaaacaaaagga

SEQ ID NO: 234141 - DNA, 24 bp, Artificial sequence
  SiRNA target sequence
caaggcttattaaaacaaaaggat

SEQ ID NO: 234142 - DNA, 24 bp, Artificial sequence
  SiRNA target sequence
aaggcttattaaaacaaaaggatg

SEQ ID NO: 234143 - DNA, 24 bp, Artificial sequence
  SiRNA target sequence
aggcttattaaaacaaaaggatgg

SEQ ID NO: 234144 - DNA, 24 bp, Artificial sequence
  SiRNA target sequence
ggcttattaaaacaaaaggatgga

SEQ ID NO: 234145 - DNA, 24 bp, Artificial sequence
  SiRNA target sequence
gcttattaaaacaaaaggatggat

SEQ ID NO: 234146 - DNA, 24 bp, Artificial sequence
  SiRNA target sequence
cttattaaaacaaaaggatggatt

SEQ ID NO: 234147 - DNA, 24 bp, Artificial sequence
  SiRNA target sequence
ttattaaaacaaaaggatggatta

SEQ ID NO: 234148 - DNA, 24 bp, Artificial sequence
  SiRNA target sequence
tattaaaacaaaaggatggattac

SEQ ID NO: 234149 - DNA, 24 bp, Artificial sequence
  SiRNA target sequence
attaaaacaaaaggatggattaca

SEQ ID NO: 234150 - DNA, 24 bp, Artificial sequence
  SiRNA target sequence
ttaaaacaaaaggatggattacaa

SEQ ID NO: 234151 - DNA, 24 bp, Artificial sequence
  SiRNA target sequence
taaaacaaaaggatggattacaat

SEQ ID NO: 234152 - DNA, 24 bp, Artificial sequence
  SiRNA target sequence
aaaacaaaaggatggattacaata

SEQ ID NO: 234153 - DNA, 24 bp, Artificial sequence
  SiRNA target sequence
aaacaaaaggatggattacaatag

SEQ ID NO: 234154 - DNA, 24 bp, Artificial sequence
  SiRNA target sequence
aacaaaaggatggattacaatagc

SEQ ID NO: 234155 - DNA, 24 bp, Artificial sequence
  SiRNA target sequence
acaaaaggatggattacaatagcc

SEQ ID NO: 234156 - DNA, 24 bp, Artificial sequence
  SiRNA target sequence
caaaaggatggattacaatagcca

SEQ ID NO: 234157 - DNA, 24 bp, Artificial sequence
  SiRNA target sequence
aaaaggatggattacaatagccat

SEQ ID NO: 234158 - DNA, 24 bp, Artificial sequence
  SiRNA target sequence
aaaggatggattacaatagccatt

SEQ ID NO: 234159 - DNA, 24 bp, Artificial sequence
  SiRNA target sequence
aaggatggattacaatagccattc

SEQ ID NO: 234160 - DNA, 24 bp, Artificial sequence
  SiRNA target sequence
aggatggattacaatagccattct

SEQ ID NO: 234161 - DNA, 24 bp, Artificial sequence
  SiRNA target sequence
ggatggattacaatagccattcta

SEQ ID NO: 234162 - DNA, 24 bp, Artificial sequence
  SiRNA target sequence
gatggattacaatagccattctat

SEQ ID NO: 234163 - DNA, 24 bp, Artificial sequence
  SiRNA target sequence
atggattacaatagccattctatg

SEQ ID NO: 234164 - DNA, 24 bp, Artificial sequence
  SiRNA target sequence
tggattacaatagccattctatgt

SEQ ID NO: 234165 - DNA, 24 bp, Artificial sequence
  SiRNA target sequence
ggattacaatagccattctatgtc

SEQ ID NO: 234166 - DNA, 24 bp, Artificial sequence
  SiRNA target sequence
gattacaatagccattctatgtcc

SEQ ID NO: 234167 - DNA, 24 bp, Artificial sequence
  SiRNA target sequence
attacaatagccattctatgtcct

SEQ ID NO: 234168 - DNA, 24 bp, Artificial sequence
  SiRNA target sequence
ttacaatagccattctatgtccta

SEQ ID NO: 234169 - DNA, 24 bp, Artificial sequence
  SiRNA target sequence
tacaatagccattctatgtcctat

SEQ ID NO: 234170 - DNA, 24 bp, Artificial sequence
  SiRNA target sequence
acaatagccattctatgtcctatt

SEQ ID NO: 234171 - DNA, 24 bp, Artificial sequence
  SiRNA target sequence
caatagccattctatgtcctatta

SEQ ID NO: 234172 - DNA, 24 bp, Artificial sequence
  SiRNA target sequence
aatagccattctatgtcctattat

SEQ ID NO: 234173 - DNA, 24 bp, Artificial sequence
  SiRNA target sequence
atagccattctatgtcctattatt

SEQ ID NO: 234174 - DNA, 24 bp, Artificial sequence
  SiRNA target sequence
tagccattctatgtcctattatta

SEQ ID NO: 234175 - DNA, 24 bp, Artificial sequence
  SiRNA target sequence
agccattctatgtcctattattac

SEQ ID NO: 234176 - DNA, 24 bp, Artificial sequence
  SiRNA target sequence
gccattctatgtcctattattact

SEQ ID NO: 234177 - DNA, 24 bp, Artificial sequence
  SiRNA target sequence
ccattctatgtcctattattactt

SEQ ID NO: 234178 - DNA, 24 bp, Artificial sequence
  SiRNA target sequence
cattctatgtcctattattacttt

SEQ ID NO: 234179 - DNA, 24 bp, Artificial sequence
  SiRNA target sequence
attctatgtcctattattactttt

SEQ ID NO: 234180 - DNA, 24 bp, Artificial sequence
  SiRNA target sequence
ttctatgtcctattattacttttt

SEQ ID NO: 234181 - DNA, 24 bp, Artificial sequence
  SiRNA target sequence
tctatgtcctattattactttttt

SEQ ID NO: 234182 - DNA, 24 bp, Artificial sequence
  SiRNA target sequence
ctatgtcctattattacttttttt

SEQ ID NO: 234183 - DNA, 24 bp, Artificial sequence
  SiRNA target sequence
tatgtcctattattactttttttt

SEQ ID NO: 234184 - DNA, 24 bp, Artificial sequence
  SiRNA target sequence
atgtcctattattacttttttttc

SEQ ID NO: 234185 - DNA, 24 bp, Artificial sequence
  SiRNA target sequence
tgtcctattattacttttttttct

SEQ ID NO: 234186 - DNA, 24 bp, Artificial sequence
  SiRNA target sequence
gtcctattattacttttttttctg

SEQ ID NO: 234187 - DNA, 24 bp, Artificial sequence
  SiRNA target sequence
tcctattattacttttttttctgc

SEQ ID NO: 234188 - DNA, 24 bp, Artificial sequence
  SiRNA target sequence
cctattattacttttttttctgct

SEQ ID NO: 234189 - DNA, 24 bp, Artificial sequence
  SiRNA target sequence
ctattattacttttttttctgctt

SEQ ID NO: 234190 - DNA, 24 bp, Artificial sequence
  SiRNA target sequence
tattattacttttttttctgcttt

SEQ ID NO: 234191 - DNA, 24 bp, Artificial sequence
  SiRNA target sequence
attattacttttttttctgctttt

SEQ ID NO: 234192 - DNA, 24 bp, Artificial sequence
  SiRNA target sequence
ttattacttttttttctgcttttg

SEQ ID NO: 234193 - DNA, 24 bp, Artificial sequence
  SiRNA target sequence
tattacttttttttctgcttttgg

SEQ ID NO: 234194 - DNA, 24 bp, Artificial sequence
  SiRNA target sequence
attacttttttttctgcttttggt

SEQ ID NO: 234195 - DNA, 24 bp, Artificial sequence
  SiRNA target sequence
ttacttttttttctgcttttggta

SEQ ID NO: 234196 - DNA, 24 bp, Artificial sequence
  SiRNA target sequence
tacttttttttctgcttttggtac

SEQ ID NO: 234197 - DNA, 24 bp, Artificial sequence
  SiRNA target sequence
acttttttttctgcttttggtact

SEQ ID NO: 234198 - DNA, 24 bp, Artificial sequence
  SiRNA target sequence
cttttttttctgcttttggtactt

SEQ ID NO: 234199 - DNA, 24 bp, Artificial sequence
  SiRNA target sequence
ttttttttctgcttttggtacttt

SEQ ID NO: 234200 - DNA, 24 bp, Artificial sequence
  SiRNA target sequence
tttttttctgcttttggtactttt

SEQ ID NO: 234201 - DNA, 24 bp, Artificial sequence
  SiRNA target sequence
ttttttctgcttttggtacttttg

SEQ ID NO: 234202 - DNA, 24 bp, Artificial sequence
  SiRNA target sequence
tttttctgcttttggtacttttgt

SEQ ID NO: 234203 - DNA, 24 bp, Artificial sequence
  SiRNA target sequence
ttttctgcttttggtacttttgta

SEQ ID NO: 234204 - DNA, 24 bp, Artificial sequence
  SiRNA target sequence
tttctgcttttggtacttttgtat

SEQ ID NO: 234205 - DNA, 24 bp, Artificial sequence
  SiRNA target sequence
ttctgcttttggtacttttgtatt

SEQ ID NO: 234206 - DNA, 24 bp, Artificial sequence
  SiRNA target sequence
tctgcttttggtacttttgtatta

SEQ ID NO: 234207 - DNA, 24 bp, Artificial sequence
  SiRNA target sequence
ctgcttttggtacttttgtattag

SEQ ID NO: 234208 - DNA, 24 bp, Artificial sequence
  SiRNA target sequence
tgcttttggtacttttgtattagc

SEQ ID NO: 234209 - DNA, 24 bp, Artificial sequence
  SiRNA target sequence
gcttttggtacttttgtattagct

SEQ ID NO: 234210 - DNA, 24 bp, Artificial sequence
  SiRNA target sequence
cttttggtacttttgtattagctt

SEQ ID NO: 234211 - DNA, 24 bp, Artificial sequence
  SiRNA target sequence
ttttggtacttttgtattagctta

SEQ ID NO: 234212 - DNA, 24 bp, Artificial sequence
  SiRNA target sequence
tttggtacttttgtattagcttat

SEQ ID NO: 234213 - DNA, 24 bp, Artificial sequence
  SiRNA target sequence
ttggtacttttgtattagcttatt

SEQ ID NO: 234214 - DNA, 24 bp, Artificial sequence
  SiRNA target sequence
tggtacttttgtattagcttattt

SEQ ID NO: 234215 - DNA, 24 bp, Artificial sequence
  SiRNA target sequence
ggtacttttgtattagcttattta

SEQ ID NO: 234216 - DNA, 24 bp, Artificial sequence
  SiRNA target sequence
gtacttttgtattagcttatttaa

SEQ ID NO: 234217 - DNA, 24 bp, Artificial sequence
  SiRNA target sequence
tacttttgtattagcttatttaaa

SEQ ID NO: 234218 - DNA, 24 bp, Artificial sequence
  SiRNA target sequence
acttttgtattagcttatttaaac

SEQ ID NO: 234219 - DNA, 24 bp, Artificial sequence
  SiRNA target sequence
cttttgtattagcttatttaaact

SEQ ID NO: 234220 - DNA, 24 bp, Artificial sequence
  SiRNA target sequence
ttttgtattagcttatttaaactt

SEQ ID NO: 234221 - DNA, 24 bp, Artificial sequence
  SiRNA target sequence
tttgtattagcttatttaaacttc

SEQ ID NO: 234222 - DNA, 24 bp, Artificial sequence
  SiRNA target sequence
ttgtattagcttatttaaacttcc

SEQ ID NO: 234223 - DNA, 24 bp, Artificial sequence
  SiRNA target sequence
tgtattagcttatttaaacttccc

SEQ ID NO: 234224 - DNA, 24 bp, Artificial sequence
  SiRNA target sequence
gtattagcttatttaaacttccca

SEQ ID NO: 234225 - DNA, 24 bp, Artificial sequence
  SiRNA target sequence
tattagcttatttaaacttcccaa

SEQ ID NO: 234226 - DNA, 24 bp, Artificial sequence
  SiRNA target sequence
attagcttatttaaacttcccaat

SEQ ID NO: 234227 - DNA, 24 bp, Artificial sequence
  SiRNA target sequence
ttagcttatttaaacttcccaatt

SEQ ID NO: 234228 - DNA, 24 bp, Artificial sequence
  SiRNA target sequence
tagcttatttaaacttcccaatta

SEQ ID NO: 234229 - DNA, 24 bp, Artificial sequence
  SiRNA target sequence
agcttatttaaacttcccaattac

SEQ ID NO: 234230 - DNA, 24 bp, Artificial sequence
  SiRNA target sequence
gcttatttaaacttcccaattaca

SEQ ID NO: 234231 - DNA, 24 bp, Artificial sequence
  SiRNA target sequence
cttatttaaacttcccaattacaa

SEQ ID NO: 234232 - DNA, 24 bp, Artificial sequence
  SiRNA target sequence
ttatttaaacttcccaattacaaa

SEQ ID NO: 234233 - DNA, 24 bp, Artificial sequence
  SiRNA target sequence
tatttaaacttcccaattacaaac

SEQ ID NO: 234234 - DNA, 24 bp, Artificial sequence
  SiRNA target sequence
atttaaacttcccaattacaaaca

SEQ ID NO: 234235 - DNA, 24 bp, Artificial sequence
  SiRNA target sequence
tttaaacttcccaattacaaacaa

SEQ ID NO: 234236 - DNA, 24 bp, Artificial sequence
  SiRNA target sequence
ttaaacttcccaattacaaacaaa

SEQ ID NO: 234237 - DNA, 24 bp, Artificial sequence
  SiRNA target sequence
taaacttcccaattacaaacaaag

SEQ ID NO: 234238 - DNA, 24 bp, Artificial sequence
  SiRNA target sequence
aaacttcccaattacaaacaaaga

SEQ ID NO: 234239 - DNA, 24 bp, Artificial sequence
  SiRNA target sequence
aacttcccaattacaaacaaagag

SEQ ID NO: 234240 - DNA, 24 bp, Artificial sequence
  SiRNA target sequence
acttcccaattacaaacaaagagg

SEQ ID NO: 234241 - DNA, 24 bp, Artificial sequence
  SiRNA target sequence
cttcccaattacaaacaaagagga

SEQ ID NO: 234242 - DNA, 24 bp, Artificial sequence
  SiRNA target sequence
ttcccaattacaaacaaagaggat

SEQ ID NO: 234243 - DNA, 24 bp, Artificial sequence
  SiRNA target sequence
tcccaattacaaacaaagaggata

SEQ ID NO: 234244 - DNA, 24 bp, Artificial sequence
  SiRNA target sequence
cccaattacaaacaaagaggataa

SEQ ID NO: 234245 - DNA, 24 bp, Artificial sequence
  SiRNA target sequence
ccaattacaaacaaagaggataat

SEQ ID NO: 234246 - DNA, 24 bp, Artificial sequence
  SiRNA target sequence
caattacaaacaaagaggataata

SEQ ID NO: 234247 - DNA, 24 bp, Artificial sequence
  SiRNA target sequence
aattacaaacaaagaggataatat

SEQ ID NO: 234248 - DNA, 24 bp, Artificial sequence
  SiRNA target sequence
attacaaacaaagaggataatata

SEQ ID NO: 234249 - DNA, 24 bp, Artificial sequence
  SiRNA target sequence
ttacaaacaaagaggataatatat

SEQ ID NO: 234250 - DNA, 24 bp, Artificial sequence
  SiRNA target sequence
tacaaacaaagaggataatatatt

SEQ ID NO: 234251 - DNA, 24 bp, Artificial sequence
  SiRNA target sequence
acaaacaaagaggataatatattt

SEQ ID NO: 234252 - DNA, 24 bp, Artificial sequence
  SiRNA target sequence
caaacaaagaggataatatatttg

SEQ ID NO: 234253 - DNA, 24 bp, Artificial sequence
  SiRNA target sequence
aaacaaagaggataatatatttga

SEQ ID NO: 234254 - DNA, 24 bp, Artificial sequence
  SiRNA target sequence
aacaaagaggataatatatttgat

SEQ ID NO: 234255 - DNA, 24 bp, Artificial sequence
  SiRNA target sequence
acaaagaggataatatatttgata

SEQ ID NO: 234256 - DNA, 24 bp, Artificial sequence
  SiRNA target sequence
caaagaggataatatatttgatat

SEQ ID NO: 234257 - DNA, 24 bp, Artificial sequence
  SiRNA target sequence
aaagaggataatatatttgatatt

SEQ ID NO: 234258 - DNA, 24 bp, Artificial sequence
  SiRNA target sequence
aagaggataatatatttgatattt

SEQ ID NO: 234259 - DNA, 24 bp, Artificial sequence
  SiRNA target sequence
agaggataatatatttgatattta

SEQ ID NO: 234260 - DNA, 24 bp, Artificial sequence
  SiRNA target sequence
gaggataatatatttgatatttac

SEQ ID NO: 234261 - DNA, 24 bp, Artificial sequence
  SiRNA target sequence
aggataatatatttgatatttacc

SEQ ID NO: 234262 - DNA, 24 bp, Artificial sequence
  SiRNA target sequence
ggataatatatttgatatttaccg

SEQ ID NO: 234263 - DNA, 24 bp, Artificial sequence
  SiRNA target sequence
gataatatatttgatatttaccgt

SEQ ID NO: 234264 - DNA, 24 bp, Artificial sequence
  SiRNA target sequence
ataatatatttgatatttaccgtt

SEQ ID NO: 234265 - DNA, 24 bp, Artificial sequence
  SiRNA target sequence
taatatatttgatatttaccgttt

SEQ ID NO: 234266 - DNA, 24 bp, Artificial sequence
  SiRNA target sequence
aatatatttgatatttaccgttta

SEQ ID NO: 234267 - DNA, 24 bp, Artificial sequence
  SiRNA target sequence
atatatttgatatttaccgtttac

SEQ ID NO: 234268 - DNA, 24 bp, Artificial sequence
  SiRNA target sequence
tatatttgatatttaccgtttacc

SEQ ID NO: 234269 - DNA, 24 bp, Artificial sequence
  SiRNA target sequence
atatttgatatttaccgtttaccg

SEQ ID NO: 234270 - DNA, 24 bp, Artificial sequence
  SiRNA target sequence
tatttgatatttaccgtttaccgt

SEQ ID NO: 234271 - DNA, 24 bp, Artificial sequence
  SiRNA target sequence
atttgatatttaccgtttaccgtc

SEQ ID NO: 234272 - DNA, 24 bp, Artificial sequence
  SiRNA target sequence
tttgatatttaccgtttaccgtca

SEQ ID NO: 234273 - DNA, 24 bp, Artificial sequence
  SiRNA target sequence
ttgatatttaccgtttaccgtcaa

SEQ ID NO: 234274 - DNA, 24 bp, Artificial sequence
  SiRNA target sequence
tgatatttaccgtttaccgtcaac

SEQ ID NO: 234275 - DNA, 24 bp, Artificial sequence
  SiRNA target sequence
gatatttaccgtttaccgtcaact

SEQ ID NO: 234276 - DNA, 24 bp, Artificial sequence
  SiRNA target sequence
atatttaccgtttaccgtcaactg

SEQ ID NO: 234277 - DNA, 24 bp, Artificial sequence
  SiRNA target sequence
tatttaccgtttaccgtcaactga

SEQ ID NO: 234278 - DNA, 24 bp, Artificial sequence
  SiRNA target sequence
atttaccgtttaccgtcaactgat

SEQ ID NO: 234279 - DNA, 24 bp, Artificial sequence
  SiRNA target sequence
tttaccgtttaccgtcaactgatt

SEQ ID NO: 234280 - DNA, 24 bp, Artificial sequence
  SiRNA target sequence
ttaccgtttaccgtcaactgattc

SEQ ID NO: 234281 - DNA, 24 bp, Artificial sequence
  SiRNA target sequence
taccgtttaccgtcaactgattct

SEQ ID NO: 234282 - DNA, 24 bp, Artificial sequence
  SiRNA target sequence
accgtttaccgtcaactgattcta

SEQ ID NO: 234283 - DNA, 24 bp, Artificial sequence
  SiRNA target sequence
ccgtttaccgtcaactgattctat

SEQ ID NO: 234284 - DNA, 24 bp, Artificial sequence
  SiRNA target sequence
cgtttaccgtcaactgattctata

SEQ ID NO: 234285 - DNA, 24 bp, Artificial sequence
  SiRNA target sequence
gtttaccgtcaactgattctataa

SEQ ID NO: 234286 - DNA, 24 bp, Artificial sequence
  SiRNA target sequence
tttaccgtcaactgattctataat

SEQ ID NO: 234287 - DNA, 24 bp, Artificial sequence
  SiRNA target sequence
ttaccgtcaactgattctataatc

SEQ ID NO: 234288 - DNA, 24 bp, Artificial sequence
  SiRNA target sequence
taccgtcaactgattctataatca

SEQ ID NO: 234289 - DNA, 24 bp, Artificial sequence
  SiRNA target sequence
accgtcaactgattctataatcaa

SEQ ID NO: 234290 - DNA, 24 bp, Artificial sequence
  SiRNA target sequence
ccgtcaactgattctataatcaaa

SEQ ID NO: 234291 - DNA, 24 bp, Artificial sequence
  SiRNA target sequence
cgtcaactgattctataatcaaat

SEQ ID NO: 234292 - DNA, 24 bp, Artificial sequence
  SiRNA target sequence
gtcaactgattctataatcaaatt

SEQ ID NO: 234293 - DNA, 24 bp, Artificial sequence
  SiRNA target sequence
tcaactgattctataatcaaatta

SEQ ID NO: 234294 - DNA, 24 bp, Artificial sequence
  SiRNA target sequence
caactgattctataatcaaattag

SEQ ID NO: 234295 - DNA, 24 bp, Artificial sequence
  SiRNA target sequence
aactgattctataatcaaattaga

SEQ ID NO: 234296 - DNA, 24 bp, Artificial sequence
  SiRNA target sequence
actgattctataatcaaattagaa

SEQ ID NO: 234297 - DNA, 24 bp, Artificial sequence
  SiRNA target sequence
ctgattctataatcaaattagaaa

SEQ ID NO: 234298 - DNA, 24 bp, Artificial sequence
  SiRNA target sequence
tgattctataatcaaattagaaaa

SEQ ID NO: 234299 - DNA, 24 bp, Artificial sequence
  SiRNA target sequence
gattctataatcaaattagaaaat

SEQ ID NO: 234300 - DNA, 24 bp, Artificial sequence
  SiRNA target sequence
attctataatcaaattagaaaata

SEQ ID NO: 234301 - DNA, 24 bp, Artificial sequence
  SiRNA target sequence
ttctataatcaaattagaaaatat

SEQ ID NO: 234302 - DNA, 24 bp, Artificial sequence
  SiRNA target sequence
tctataatcaaattagaaaatatt

SEQ ID NO: 234303 - DNA, 24 bp, Artificial sequence
  SiRNA target sequence
ctataatcaaattagaaaatattg

SEQ ID NO: 234304 - DNA, 24 bp, Artificial sequence
  SiRNA target sequence
tataatcaaattagaaaatattgt

SEQ ID NO: 234305 - DNA, 24 bp, Artificial sequence
  SiRNA target sequence
ataatcaaattagaaaatattgtt

SEQ ID NO: 234306 - DNA, 24 bp, Artificial sequence
  SiRNA target sequence
taatcaaattagaaaatattgttg

SEQ ID NO: 234307 - DNA, 24 bp, Artificial sequence
  SiRNA target sequence
aatcaaattagaaaatattgttgg

SEQ ID NO: 234308 - DNA, 24 bp, Artificial sequence
  SiRNA target sequence
atcaaattagaaaatattgttggt

SEQ ID NO: 234309 - DNA, 24 bp, Artificial sequence
  SiRNA target sequence
tcaaattagaaaatattgttggtg

SEQ ID NO: 234310 - DNA, 24 bp, Artificial sequence
  SiRNA target sequence
caaattagaaaatattgttggtgt

SEQ ID NO: 234311 - DNA, 24 bp, Artificial sequence
  SiRNA target sequence
aaattagaaaatattgttggtgtc

SEQ ID NO: 234312 - DNA, 24 bp, Artificial sequence
  SiRNA target sequence
aattagaaaatattgttggtgtca

SEQ ID NO: 234313 - DNA, 24 bp, Artificial sequence
  SiRNA target sequence
attagaaaatattgttggtgtcat

SEQ ID NO: 234314 - DNA, 24 bp, Artificial sequence
  SiRNA target sequence
ttagaaaatattgttggtgtcatt

SEQ ID NO: 234315 - DNA, 24 bp, Artificial sequence
  SiRNA target sequence
tagaaaatattgttggtgtcattt

SEQ ID NO: 234316 - DNA, 24 bp, Artificial sequence
  SiRNA target sequence
agaaaatattgttggtgtcatttg

SEQ ID NO: 234317 - DNA, 24 bp, Artificial sequence
  SiRNA target sequence
gaaaatattgttggtgtcatttgt

SEQ ID NO: 234318 - DNA, 24 bp, Artificial sequence
  SiRNA target sequence
aaaatattgttggtgtcatttgtg

SEQ ID NO: 234319 - DNA, 24 bp, Artificial sequence
  SiRNA target sequence
aaatattgttggtgtcatttgtgt

SEQ ID NO: 234320 - DNA, 24 bp, Artificial sequence
  SiRNA target sequence
aatattgttggtgtcatttgtgta

SEQ ID NO: 234321 - DNA, 24 bp, Artificial sequence
  SiRNA target sequence
atattgttggtgtcatttgtgtat

SEQ ID NO: 234322 - DNA, 24 bp, Artificial sequence
  SiRNA target sequence
tattgttggtgtcatttgtgtatc

SEQ ID NO: 234323 - DNA, 24 bp, Artificial sequence
  SiRNA target sequence
attgttggtgtcatttgtgtatct

SEQ ID NO: 234324 - DNA, 24 bp, Artificial sequence
  SiRNA target sequence
ttgttggtgtcatttgtgtatctt

SEQ ID NO: 234325 - DNA, 24 bp, Artificial sequence
  SiRNA target sequence
tgttggtgtcatttgtgtatcttt

SEQ ID NO: 234326 - DNA, 24 bp, Artificial sequence
  SiRNA target sequence
gttggtgtcatttgtgtatcttta

SEQ ID NO: 234327 - DNA, 24 bp, Artificial sequence
  SiRNA target sequence
ttggtgtcatttgtgtatctttaa

SEQ ID NO: 234328 - DNA, 24 bp, Artificial sequence
  SiRNA target sequence
tggtgtcatttgtgtatctttaat

SEQ ID NO: 234329 - DNA, 24 bp, Artificial sequence
  SiRNA target sequence
ggtgtcatttgtgtatctttaatg

SEQ ID NO: 234330 - DNA, 24 bp, Artificial sequence
  SiRNA target sequence
gtgtcatttgtgtatctttaatga

SEQ ID NO: 234331 - DNA, 24 bp, Artificial sequence
  SiRNA target sequence
tgtcatttgtgtatctttaatgaa

SEQ ID NO: 234332 - DNA, 24 bp, Artificial sequence
  SiRNA target sequence
gtcatttgtgtatctttaatgaag

SEQ ID NO: 234333 - DNA, 24 bp, Artificial sequence
  SiRNA target sequence
tcatttgtgtatctttaatgaaga

SEQ ID NO: 234334 - DNA, 24 bp, Artificial sequence
  SiRNA target sequence
catttgtgtatctttaatgaagat

SEQ ID NO: 234335 - DNA, 24 bp, Artificial sequence
  SiRNA target sequence
atttgtgtatctttaatgaagatt

SEQ ID NO: 234336 - DNA, 24 bp, Artificial sequence
  SiRNA target sequence
tttgtgtatctttaatgaagattt

SEQ ID NO: 234337 - DNA, 24 bp, Artificial sequence
  SiRNA target sequence
ttgtgtatctttaatgaagatttc

SEQ ID NO: 234338 - DNA, 24 bp, Artificial sequence
  SiRNA target sequence
tgtgtatctttaatgaagatttct

SEQ ID NO: 234339 - DNA, 24 bp, Artificial sequence
  SiRNA target sequence
gtgtatctttaatgaagatttcta

SEQ ID NO: 234340 - DNA, 24 bp, Artificial sequence
  SiRNA target sequence
tgtatctttaatgaagatttctaa

SEQ ID NO: 234341 - DNA, 24 bp, Artificial sequence
  SiRNA target sequence
gtatctttaatgaagatttctaaa

SEQ ID NO: 234342 - DNA, 24 bp, Artificial sequence
  SiRNA target sequence
tatctttaatgaagatttctaaat

SEQ ID NO: 234343 - DNA, 24 bp, Artificial sequence
  SiRNA target sequence
atctttaatgaagatttctaaata

SEQ ID NO: 234344 - DNA, 24 bp, Artificial sequence
  SiRNA target sequence
tctttaatgaagatttctaaatat

SEQ ID NO: 234345 - DNA, 24 bp, Artificial sequence
  SiRNA target sequence
ctttaatgaagatttctaaatatg

SEQ ID NO: 234346 - DNA, 24 bp, Artificial sequence
  SiRNA target sequence
tttaatgaagatttctaaatatgc

SEQ ID NO: 234347 - DNA, 24 bp, Artificial sequence
  SiRNA target sequence
ttaatgaagatttctaaatatgca

SEQ ID NO: 234348 - DNA, 24 bp, Artificial sequence
  SiRNA target sequence
taatgaagatttctaaatatgcag

SEQ ID NO: 234349 - DNA, 24 bp, Artificial sequence
  SiRNA target sequence
aatgaagatttctaaatatgcagc

SEQ ID NO: 234350 - DNA, 24 bp, Artificial sequence
  SiRNA target sequence
atgaagatttctaaatatgcagca

SEQ ID NO: 234351 - DNA, 24 bp, Artificial sequence
  SiRNA target sequence
tgaagatttctaaatatgcagcat

SEQ ID NO: 234352 - DNA, 24 bp, Artificial sequence
  SiRNA target sequence
gaagatttctaaatatgcagcatt

SEQ ID NO: 234353 - DNA, 24 bp, Artificial sequence
  SiRNA target sequence
aagatttctaaatatgcagcattt

SEQ ID NO: 234354 - DNA, 24 bp, Artificial sequence
  SiRNA target sequence
agatttctaaatatgcagcatttg

SEQ ID NO: 234355 - DNA, 24 bp, Artificial sequence
  SiRNA target sequence
gatttctaaatatgcagcatttga

SEQ ID NO: 234356 - DNA, 24 bp, Artificial sequence
  SiRNA target sequence
atttctaaatatgcagcatttgat

SEQ ID NO: 234357 - DNA, 24 bp, Artificial sequence
  SiRNA target sequence
tttctaaatatgcagcatttgata

SEQ ID NO: 234358 - DNA, 24 bp, Artificial sequence
  SiRNA target sequence
ttctaaatatgcagcatttgatat

SEQ ID NO: 234359 - DNA, 24 bp, Artificial sequence
  SiRNA target sequence
tctaaatatgcagcatttgatatc

SEQ ID NO: 234360 - DNA, 24 bp, Artificial sequence
  SiRNA target sequence
ctaaatatgcagcatttgatatca

SEQ ID NO: 234361 - DNA, 24 bp, Artificial sequence
  SiRNA target sequence
taaatatgcagcatttgatatcac

SEQ ID NO: 234362 - DNA, 24 bp, Artificial sequence
  SiRNA target sequence
aaatatgcagcatttgatatcaca

SEQ ID NO: 234363 - DNA, 24 bp, Artificial sequence
  SiRNA target sequence
aatatgcagcatttgatatcacaa

SEQ ID NO: 234364 - DNA, 24 bp, Artificial sequence
  SiRNA target sequence
atatgcagcatttgatatcacaaa

SEQ ID NO: 234365 - DNA, 24 bp, Artificial sequence
  SiRNA target sequence
tatgcagcatttgatatcacaaaa

SEQ ID NO: 234366 - DNA, 24 bp, Artificial sequence
  SiRNA target sequence
atgcagcatttgatatcacaaaag

SEQ ID NO: 234367 - DNA, 24 bp, Artificial sequence
  SiRNA target sequence
tgcagcatttgatatcacaaaaga

SEQ ID NO: 234368 - DNA, 24 bp, Artificial sequence
  SiRNA target sequence
gcagcatttgatatcacaaaagag

SEQ ID NO: 234369 - DNA, 24 bp, Artificial sequence
  SiRNA target sequence
cagcatttgatatcacaaaagagg

SEQ ID NO: 234370 - DNA, 24 bp, Artificial sequence
  SiRNA target sequence
agcatttgatatcacaaaagaggc

SEQ ID NO: 234371 - DNA, 24 bp, Artificial sequence
  SiRNA target sequence
gcatttgatatcacaaaagaggct

SEQ ID NO: 234372 - DNA, 24 bp, Artificial sequence
  SiRNA target sequence
catttgatatcacaaaagaggctt

SEQ ID NO: 234373 - DNA, 24 bp, Artificial sequence
  SiRNA target sequence
atttgatatcacaaaagaggcttt

SEQ ID NO: 234374 - DNA, 24 bp, Artificial sequence
  SiRNA target sequence
tttgatatcacaaaagaggctttg

SEQ ID NO: 234375 - DNA, 24 bp, Artificial sequence
  SiRNA target sequence
ttgatatcacaaaagaggctttgt

SEQ ID NO: 234376 - DNA, 24 bp, Artificial sequence
  SiRNA target sequence
tgatatcacaaaagaggctttgtc

SEQ ID NO: 234377 - DNA, 24 bp, Artificial sequence
  SiRNA target sequence
gatatcacaaaagaggctttgtct

SEQ ID NO: 234378 - DNA, 24 bp, Artificial sequence
  SiRNA target sequence
atatcacaaaagaggctttgtcta

SEQ ID NO: 234379 - DNA, 24 bp, Artificial sequence
  SiRNA target sequence
tatcacaaaagaggctttgtctat

SEQ ID NO: 234380 - DNA, 24 bp, Artificial sequence
  SiRNA target sequence
atcacaaaagaggctttgtctatg

SEQ ID NO: 234381 - DNA, 24 bp, Artificial sequence
  SiRNA target sequence
tcacaaaagaggctttgtctatgc

SEQ ID NO: 234382 - DNA, 24 bp, Artificial sequence
  SiRNA target sequence
cacaaaagaggctttgtctatgca

SEQ ID NO: 234383 - DNA, 24 bp, Artificial sequence
  SiRNA target sequence
acaaaagaggctttgtctatgcag

SEQ ID NO: 234384 - DNA, 24 bp, Artificial sequence
  SiRNA target sequence
caaaagaggctttgtctatgcaga

SEQ ID NO: 234385 - DNA, 24 bp, Artificial sequence
  SiRNA target sequence
aaaagaggctttgtctatgcagat

SEQ ID NO: 234386 - DNA, 24 bp, Artificial sequence
  SiRNA target sequence
aaagaggctttgtctatgcagatt

SEQ ID NO: 234387 - DNA, 24 bp, Artificial sequence
  SiRNA target sequence
aagaggctttgtctatgcagattg

SEQ ID NO: 234388 - DNA, 24 bp, Artificial sequence
  SiRNA target sequence
agaggctttgtctatgcagattga

SEQ ID NO: 234389 - DNA, 24 bp, Artificial sequence
  SiRNA target sequence
gaggctttgtctatgcagattgat

SEQ ID NO: 234390 - DNA, 24 bp, Artificial sequence
  SiRNA target sequence
aggctttgtctatgcagattgatg

SEQ ID NO: 234391 - DNA, 24 bp, Artificial sequence
  SiRNA target sequence
ggctttgtctatgcagattgatgg

SEQ ID NO: 234392 - DNA, 24 bp, Artificial sequence
  SiRNA target sequence
gctttgtctatgcagattgatggt

SEQ ID NO: 234393 - DNA, 24 bp, Artificial sequence
  SiRNA target sequence
ctttgtctatgcagattgatggtt

SEQ ID NO: 234394 - DNA, 24 bp, Artificial sequence
  SiRNA target sequence
tttgtctatgcagattgatggttc

SEQ ID NO: 234395 - DNA, 24 bp, Artificial sequence
  SiRNA target sequence
ttgtctatgcagattgatggttct

SEQ ID NO: 234396 - DNA, 24 bp, Artificial sequence
  SiRNA target sequence
tgtctatgcagattgatggttcta

SEQ ID NO: 234397 - DNA, 24 bp, Artificial sequence
  SiRNA target sequence
gtctatgcagattgatggttctat

SEQ ID NO: 234398 - DNA, 24 bp, Artificial sequence
  SiRNA target sequence
tctatgcagattgatggttctata

SEQ ID NO: 234399 - DNA, 24 bp, Artificial sequence
  SiRNA target sequence
ctatgcagattgatggttctataa

SEQ ID NO: 234400 - DNA, 24 bp, Artificial sequence
  SiRNA target sequence
tatgcagattgatggttctataag

SEQ ID NO: 234401 - DNA, 24 bp, Artificial sequence
  SiRNA target sequence
atgcagattgatggttctataaga

SEQ ID NO: 234402 - DNA, 24 bp, Artificial sequence
  SiRNA target sequence
tgcagattgatggttctataagag

SEQ ID NO: 234403 - DNA, 24 bp, Artificial sequence
  SiRNA target sequence
gcagattgatggttctataagagc

SEQ ID NO: 234404 - DNA, 24 bp, Artificial sequence
  SiRNA target sequence
cagattgatggttctataagagcg

SEQ ID NO: 234405 - DNA, 24 bp, Artificial sequence
  SiRNA target sequence
agattgatggttctataagagcga

SEQ ID NO: 234406 - DNA, 24 bp, Artificial sequence
  SiRNA target sequence
gattgatggttctataagagcgaa

SEQ ID NO: 234407 - DNA, 24 bp, Artificial sequence
  SiRNA target sequence
attgatggttctataagagcgaaa

SEQ ID NO: 234408 - DNA, 24 bp, Artificial sequence
  SiRNA target sequence
ttgatggttctataagagcgaaat

SEQ ID NO: 234409 - DNA, 24 bp, Artificial sequence
  SiRNA target sequence
tgatggttctataagagcgaaata

SEQ ID NO: 234410 - DNA, 24 bp, Artificial sequence
  SiRNA target sequence
gatggttctataagagcgaaatac

SEQ ID NO: 234411 - DNA, 24 bp, Artificial sequence
  SiRNA target sequence
atggttctataagagcgaaataca

SEQ ID NO: 234412 - DNA, 24 bp, Artificial sequence
  SiRNA target sequence
tggttctataagagcgaaatacaa

SEQ ID NO: 234413 - DNA, 24 bp, Artificial sequence
  SiRNA target sequence
ggttctataagagcgaaatacaaa

SEQ ID NO: 234414 - DNA, 24 bp, Artificial sequence
  SiRNA target sequence
gttctataagagcgaaatacaaag

SEQ ID NO: 234415 - DNA, 24 bp, Artificial sequence
  SiRNA target sequence
ttctataagagcgaaatacaaagg

SEQ ID NO: 234416 - DNA, 24 bp, Artificial sequence
  SiRNA target sequence
tctataagagcgaaatacaaaggt

SEQ ID NO: 234417 - DNA, 24 bp, Artificial sequence
  SiRNA target sequence
ctataagagcgaaatacaaaggta

SEQ ID NO: 234418 - DNA, 24 bp, Artificial sequence
  SiRNA target sequence
tataagagcgaaatacaaaggtat

SEQ ID NO: 234419 - DNA, 24 bp, Artificial sequence
  SiRNA target sequence
ataagagcgaaatacaaaggtatt

SEQ ID NO: 234420 - DNA, 24 bp, Artificial sequence
  SiRNA target sequence
taagagcgaaatacaaaggtattt

SEQ ID NO: 234421 - DNA, 24 bp, Artificial sequence
  SiRNA target sequence
aagagcgaaatacaaaggtatttt

SEQ ID NO: 234422 - DNA, 24 bp, Artificial sequence
  SiRNA target sequence
agagcgaaatacaaaggtattttt

SEQ ID NO: 234423 - DNA, 24 bp, Artificial sequence
  SiRNA target sequence
gagcgaaatacaaaggtatttttg

SEQ ID NO: 234424 - DNA, 24 bp, Artificial sequence
  SiRNA target sequence
agcgaaatacaaaggtatttttga

SEQ ID NO: 234425 - DNA, 24 bp, Artificial sequence
  SiRNA target sequence
gcgaaatacaaaggtatttttgat

SEQ ID NO: 234426 - DNA, 24 bp, Artificial sequence
  SiRNA target sequence
cgaaatacaaaggtatttttgatg

SEQ ID NO: 234427 - DNA, 24 bp, Artificial sequence
  SiRNA target sequence
gaaatacaaaggtatttttgatgg

SEQ ID NO: 234428 - DNA, 24 bp, Artificial sequence
  SiRNA target sequence
aaatacaaaggtatttttgatggt

SEQ ID NO: 234429 - DNA, 24 bp, Artificial sequence
  SiRNA target sequence
aatacaaaggtatttttgatggtg

SEQ ID NO: 234430 - DNA, 24 bp, Artificial sequence
  SiRNA target sequence
atacaaaggtatttttgatggtgt

SEQ ID NO: 234431 - DNA, 24 bp, Artificial sequence
  SiRNA target sequence
tacaaaggtatttttgatggtgta

SEQ ID NO: 234432 - DNA, 24 bp, Artificial sequence
  SiRNA target sequence
acaaaggtatttttgatggtgtat

SEQ ID NO: 234433 - DNA, 24 bp, Artificial sequence
  SiRNA target sequence
caaaggtatttttgatggtgtatt

SEQ ID NO: 234434 - DNA, 24 bp, Artificial sequence
  SiRNA target sequence
aaaggtatttttgatggtgtattt

SEQ ID NO: 234435 - DNA, 24 bp, Artificial sequence
  SiRNA target sequence
aaggtatttttgatggtgtatttg

SEQ ID NO: 234436 - DNA, 24 bp, Artificial sequence
  SiRNA target sequence
aggtatttttgatggtgtatttgg

SEQ ID NO: 234437 - DNA, 24 bp, Artificial sequence
  SiRNA target sequence
ggtatttttgatggtgtatttggt

SEQ ID NO: 234438 - DNA, 24 bp, Artificial sequence
  SiRNA target sequence
gtatttttgatggtgtatttggta

SEQ ID NO: 234439 - DNA, 24 bp, Artificial sequence
  SiRNA target sequence
tatttttgatggtgtatttggtaa

SEQ ID NO: 234440 - DNA, 24 bp, Artificial sequence
  SiRNA target sequence
atttttgatggtgtatttggtaag

SEQ ID NO: 234441 - DNA, 24 bp, Artificial sequence
  SiRNA target sequence
tttttgatggtgtatttggtaagc

SEQ ID NO: 234442 - DNA, 24 bp, Artificial sequence
  SiRNA target sequence
ttttgatggtgtatttggtaagct

SEQ ID NO: 234443 - DNA, 24 bp, Artificial sequence
  SiRNA target sequence
tttgatggtgtatttggtaagctg

SEQ ID NO: 234444 - DNA, 24 bp, Artificial sequence
  SiRNA target sequence
ttgatggtgtatttggtaagctgg

SEQ ID NO: 234445 - DNA, 24 bp, Artificial sequence
  SiRNA target sequence
tgatggtgtatttggtaagctggg

SEQ ID NO: 234446 - DNA, 24 bp, Artificial sequence
  SiRNA target sequence
gatggtgtatttggtaagctgggg

SEQ ID NO: 234447 - DNA, 24 bp, Artificial sequence
  SiRNA target sequence
atggtgtatttggtaagctgggga

SEQ ID NO: 234448 - DNA, 24 bp, Artificial sequence
  SiRNA target sequence
tggtgtatttggtaagctggggaa

SEQ ID NO: 234449 - DNA, 24 bp, Artificial sequence
  SiRNA target sequence
ggtgtatttggtaagctggggaaa

SEQ ID NO: 234450 - DNA, 24 bp, Artificial sequence
  SiRNA target sequence
gtgtatttggtaagctggggaaat

SEQ ID NO: 234451 - DNA, 24 bp, Artificial sequence
  SiRNA target sequence
tgtatttggtaagctggggaaatc

SEQ ID NO: 234452 - DNA, 24 bp, Artificial sequence
  SiRNA target sequence
gtatttggtaagctggggaaatct

SEQ ID NO: 234453 - DNA, 24 bp, Artificial sequence
  SiRNA target sequence
tatttggtaagctggggaaatctt

SEQ ID NO: 234454 - DNA, 24 bp, Artificial sequence
  SiRNA target sequence
atttggtaagctggggaaatcttt

SEQ ID NO: 234455 - DNA, 24 bp, Artificial sequence
  SiRNA target sequence
tttggtaagctggggaaatctttt

SEQ ID NO: 234456 - DNA, 24 bp, Artificial sequence
  SiRNA target sequence
ttggtaagctggggaaatcttttg

SEQ ID NO: 234457 - DNA, 24 bp, Artificial sequence
  SiRNA target sequence
tggtaagctggggaaatcttttgg

SEQ ID NO: 234458 - DNA, 24 bp, Artificial sequence
  SiRNA target sequence
ggtaagctggggaaatcttttgga

SEQ ID NO: 234459 - DNA, 24 bp, Artificial sequence
  SiRNA target sequence
gtaagctggggaaatcttttggat

SEQ ID NO: 234460 - DNA, 24 bp, Artificial sequence
  SiRNA target sequence
taagctggggaaatcttttggatc

SEQ ID NO: 234461 - DNA, 24 bp, Artificial sequence
  SiRNA target sequence
aagctggggaaatcttttggatca

SEQ ID NO: 234462 - DNA, 24 bp, Artificial sequence
  SiRNA target sequence
agctggggaaatcttttggatcag

SEQ ID NO: 234463 - DNA, 24 bp, Artificial sequence
  SiRNA target sequence
gctggggaaatcttttggatcagt

SEQ ID NO: 234464 - DNA, 24 bp, Artificial sequence
  SiRNA target sequence
ctggggaaatcttttggatcagtt

SEQ ID NO: 234465 - DNA, 24 bp, Artificial sequence
  SiRNA target sequence
tggggaaatcttttggatcagttt

SEQ ID NO: 234466 - DNA, 24 bp, Artificial sequence
  SiRNA target sequence
ggggaaatcttttggatcagttta

SEQ ID NO: 234467 - DNA, 24 bp, Artificial sequence
  SiRNA target sequence
gggaaatcttttggatcagtttat

SEQ ID NO: 234468 - DNA, 24 bp, Artificial sequence
  SiRNA target sequence
ggaaatcttttggatcagtttatg

SEQ ID NO: 234469 - DNA, 24 bp, Artificial sequence
  SiRNA target sequence
gaaatcttttggatcagtttatgg

SEQ ID NO: 234470 - DNA, 24 bp, Artificial sequence
  SiRNA target sequence
aaatcttttggatcagtttatgga

SEQ ID NO: 234471 - DNA, 24 bp, Artificial sequence
  SiRNA target sequence
aatcttttggatcagtttatggat

SEQ ID NO: 234472 - DNA, 24 bp, Artificial sequence
  SiRNA target sequence
atcttttggatcagtttatggatt

SEQ ID NO: 234473 - DNA, 24 bp, Artificial sequence
  SiRNA target sequence
tcttttggatcagtttatggattt

SEQ ID NO: 234474 - DNA, 24 bp, Artificial sequence
  SiRNA target sequence
cttttggatcagtttatggattta

SEQ ID NO: 234475 - DNA, 24 bp, Artificial sequence
  SiRNA target sequence
ttttggatcagtttatggatttac

SEQ ID NO: 234476 - DNA, 24 bp, Artificial sequence
  SiRNA target sequence
tttggatcagtttatggatttaca

SEQ ID NO: 234477 - DNA, 24 bp, Artificial sequence
  SiRNA target sequence
ttggatcagtttatggatttacaa

SEQ ID NO: 234478 - DNA, 24 bp, Artificial sequence
  SiRNA target sequence
tggatcagtttatggatttacaat

SEQ ID NO: 234479 - DNA, 24 bp, Artificial sequence
  SiRNA target sequence
ggatcagtttatggatttacaatt

SEQ ID NO: 234480 - DNA, 24 bp, Artificial sequence
  SiRNA target sequence
gatcagtttatggatttacaatta

SEQ ID NO: 234481 - DNA, 24 bp, Artificial sequence
  SiRNA target sequence
atcagtttatggatttacaattac

SEQ ID NO: 234482 - DNA, 24 bp, Artificial sequence
  SiRNA target sequence
tcagtttatggatttacaattact

SEQ ID NO: 234483 - DNA, 24 bp, Artificial sequence
  SiRNA target sequence
cagtttatggatttacaattacta

SEQ ID NO: 234484 - DNA, 24 bp, Artificial sequence
  SiRNA target sequence
agtttatggatttacaattactac

SEQ ID NO: 234485 - DNA, 24 bp, Artificial sequence
  SiRNA target sequence
gtttatggatttacaattactaca

SEQ ID NO: 234486 - DNA, 24 bp, Artificial sequence
  SiRNA target sequence
tttatggatttacaattactacat

SEQ ID NO: 234487 - DNA, 24 bp, Artificial sequence
  SiRNA target sequence
ttatggatttacaattactacatt

SEQ ID NO: 234488 - DNA, 24 bp, Artificial sequence
  SiRNA target sequence
tatggatttacaattactacatta

SEQ ID NO: 234489 - DNA, 24 bp, Artificial sequence
  SiRNA target sequence
atggatttacaattactacattat

SEQ ID NO: 234490 - DNA, 24 bp, Artificial sequence
  SiRNA target sequence
tggatttacaattactacattatt

SEQ ID NO: 234491 - DNA, 24 bp, Artificial sequence
  SiRNA target sequence
ggatttacaattactacattatta

SEQ ID NO: 234492 - DNA, 24 bp, Artificial sequence
  SiRNA target sequence
gatttacaattactacattattag

SEQ ID NO: 234493 - DNA, 24 bp, Artificial sequence
  SiRNA target sequence
atttacaattactacattattagg

SEQ ID NO: 234494 - DNA, 24 bp, Artificial sequence
  SiRNA target sequence
tttacaattactacattattagga

SEQ ID NO: 234495 - DNA, 24 bp, Artificial sequence
  SiRNA target sequence
ttacaattactacattattaggaa

SEQ ID NO: 234496 - DNA, 24 bp, Artificial sequence
  SiRNA target sequence
tacaattactacattattaggaac

SEQ ID NO: 234497 - DNA, 24 bp, Artificial sequence
  SiRNA target sequence
acaattactacattattaggaaca

SEQ ID NO: 234498 - DNA, 24 bp, Artificial sequence
  SiRNA target sequence
caattactacattattaggaacaa

SEQ ID NO: 234499 - DNA, 24 bp, Artificial sequence
  SiRNA target sequence
aattactacattattaggaacaag

SEQ ID NO: 234500 - DNA, 24 bp, Artificial sequence
  SiRNA target sequence
attactacattattaggaacaaga

SEQ ID NO: 234501 - DNA, 24 bp, Artificial sequence
  SiRNA target sequence
ttactacattattaggaacaagag

SEQ ID NO: 234502 - DNA, 24 bp, Artificial sequence
  SiRNA target sequence
tactacattattaggaacaagaga

SEQ ID NO: 234503 - DNA, 24 bp, Artificial sequence
  SiRNA target sequence
actacattattaggaacaagagat

SEQ ID NO: 234504 - DNA, 24 bp, Artificial sequence
  SiRNA target sequence
ctacattattaggaacaagagatg

SEQ ID NO: 234505 - DNA, 24 bp, Artificial sequence
  SiRNA target sequence
tacattattaggaacaagagatgt

SEQ ID NO: 234506 - DNA, 24 bp, Artificial sequence
  SiRNA target sequence
acattattaggaacaagagatgtt

SEQ ID NO: 234507 - DNA, 24 bp, Artificial sequence
  SiRNA target sequence
cattattaggaacaagagatgttc

SEQ ID NO: 234508 - DNA, 24 bp, Artificial sequence
  SiRNA target sequence
attattaggaacaagagatgttcg

SEQ ID NO: 234509 - DNA, 24 bp, Artificial sequence
  SiRNA target sequence
ttattaggaacaagagatgttcgt

SEQ ID NO: 234510 - DNA, 24 bp, Artificial sequence
  SiRNA target sequence
tattaggaacaagagatgttcgta

SEQ ID NO: 234511 - DNA, 24 bp, Artificial sequence
  SiRNA target sequence
attaggaacaagagatgttcgtag

SEQ ID NO: 234512 - DNA, 24 bp, Artificial sequence
  SiRNA target sequence
ttaggaacaagagatgttcgtaga

SEQ ID NO: 234513 - DNA, 24 bp, Artificial sequence
  SiRNA target sequence
taggaacaagagatgttcgtagag

SEQ ID NO: 234514 - DNA, 24 bp, Artificial sequence
  SiRNA target sequence
aggaacaagagatgttcgtagagg

SEQ ID NO: 234515 - DNA, 24 bp, Artificial sequence
  SiRNA target sequence
ggaacaagagatgttcgtagaggt

SEQ ID NO: 234516 - DNA, 24 bp, Artificial sequence
  SiRNA target sequence
gaacaagagatgttcgtagaggtg

SEQ ID NO: 234517 - DNA, 24 bp, Artificial sequence
  SiRNA target sequence
aacaagagatgttcgtagaggtgc

SEQ ID NO: 234518 - DNA, 24 bp, Artificial sequence
  SiRNA target sequence
acaagagatgttcgtagaggtgct

SEQ ID NO: 234519 - DNA, 24 bp, Artificial sequence
  SiRNA target sequence
caagagatgttcgtagaggtgctc

SEQ ID NO: 234520 - DNA, 24 bp, Artificial sequence
  SiRNA target sequence
aagagatgttcgtagaggtgctcc

SEQ ID NO: 234521 - DNA, 24 bp, Artificial sequence
  SiRNA target sequence
agagatgttcgtagaggtgctcct

SEQ ID NO: 234522 - DNA, 24 bp, Artificial sequence
  SiRNA target sequence
gagatgttcgtagaggtgctccta

SEQ ID NO: 234523 - DNA, 24 bp, Artificial sequence
  SiRNA target sequence
agatgttcgtagaggtgctcctat

SEQ ID NO: 234524 - DNA, 24 bp, Artificial sequence
  SiRNA target sequence
gatgttcgtagaggtgctcctata

SEQ ID NO: 234525 - DNA, 24 bp, Artificial sequence
  SiRNA target sequence
atgttcgtagaggtgctcctatat

SEQ ID NO: 234526 - DNA, 24 bp, Artificial sequence
  SiRNA target sequence
tgttcgtagaggtgctcctatatc

SEQ ID NO: 234527 - DNA, 24 bp, Artificial sequence
  SiRNA target sequence
gttcgtagaggtgctcctatatcg

SEQ ID NO: 234528 - DNA, 24 bp, Artificial sequence
  SiRNA target sequence
ttcgtagaggtgctcctatatcgc

SEQ ID NO: 234529 - DNA, 24 bp, Artificial sequence
  SiRNA target sequence
tcgtagaggtgctcctatatcgct

SEQ ID NO: 234530 - DNA, 24 bp, Artificial sequence
  SiRNA target sequence
cgtagaggtgctcctatatcgctt

SEQ ID NO: 234531 - DNA, 24 bp, Artificial sequence
  SiRNA target sequence
gtagaggtgctcctatatcgcttt

SEQ ID NO: 234532 - DNA, 24 bp, Artificial sequence
  SiRNA target sequence
tagaggtgctcctatatcgctttg

SEQ ID NO: 234533 - DNA, 24 bp, Artificial sequence
  SiRNA target sequence
agaggtgctcctatatcgctttgt

SEQ ID NO: 234534 - DNA, 24 bp, Artificial sequence
  SiRNA target sequence
gaggtgctcctatatcgctttgtg

SEQ ID NO: 234535 - DNA, 24 bp, Artificial sequence
  SiRNA target sequence
aggtgctcctatatcgctttgtgt

SEQ ID NO: 234536 - DNA, 24 bp, Artificial sequence
  SiRNA target sequence
ggtgctcctatatcgctttgtgtt

SEQ ID NO: 234537 - DNA, 24 bp, Artificial sequence
  SiRNA target sequence
gtgctcctatatcgctttgtgttc

SEQ ID NO: 234538 - DNA, 24 bp, Artificial sequence
  SiRNA target sequence
tgctcctatatcgctttgtgttct

SEQ ID NO: 234539 - DNA, 24 bp, Artificial sequence
  SiRNA target sequence
gctcctatatcgctttgtgttcta

SEQ ID NO: 234540 - DNA, 24 bp, Artificial sequence
  SiRNA target sequence
ctcctatatcgctttgtgttctaa

SEQ ID NO: 234541 - DNA, 24 bp, Artificial sequence
  SiRNA target sequence
tcctatatcgctttgtgttctaat

SEQ ID NO: 234542 - DNA, 24 bp, Artificial sequence
  SiRNA target sequence
cctatatcgctttgtgttctaata

SEQ ID NO: 234543 - DNA, 24 bp, Artificial sequence
  SiRNA target sequence
ctatatcgctttgtgttctaatat

SEQ ID NO: 234544 - DNA, 24 bp, Artificial sequence
  SiRNA target sequence
tatatcgctttgtgttctaatatt

SEQ ID NO: 234545 - DNA, 24 bp, Artificial sequence
  SiRNA target sequence
atatcgctttgtgttctaatattg

SEQ ID NO: 234546 - DNA, 24 bp, Artificial sequence
  SiRNA target sequence
tatcgctttgtgttctaatattgt

SEQ ID NO: 234547 - DNA, 24 bp, Artificial sequence
  SiRNA target sequence
atcgctttgtgttctaatattgtt

SEQ ID NO: 234548 - DNA, 24 bp, Artificial sequence
  SiRNA target sequence
tcgctttgtgttctaatattgttc

SEQ ID NO: 234549 - DNA, 24 bp, Artificial sequence
  SiRNA target sequence
cgctttgtgttctaatattgttct

SEQ ID NO: 234550 - DNA, 24 bp, Artificial sequence
  SiRNA target sequence
gctttgtgttctaatattgttctg

SEQ ID NO: 234551 - DNA, 24 bp, Artificial sequence
  SiRNA target sequence
ctttgtgttctaatattgttctgc

SEQ ID NO: 234552 - DNA, 24 bp, Artificial sequence
  SiRNA target sequence
tttgtgttctaatattgttctgcc

SEQ ID NO: 234553 - DNA, 24 bp, Artificial sequence
  SiRNA target sequence
ttgtgttctaatattgttctgcct

SEQ ID NO: 234554 - DNA, 24 bp, Artificial sequence
  SiRNA target sequence
tgtgttctaatattgttctgcctt

SEQ ID NO: 234555 - DNA, 24 bp, Artificial sequence
  SiRNA target sequence
gtgttctaatattgttctgcctta

SEQ ID NO: 234556 - DNA, 24 bp, Artificial sequence
  SiRNA target sequence
tgttctaatattgttctgccttat

SEQ ID NO: 234557 - DNA, 24 bp, Artificial sequence
  SiRNA target sequence
gttctaatattgttctgccttata

SEQ ID NO: 234558 - DNA, 24 bp, Artificial sequence
  SiRNA target sequence
ttctaatattgttctgccttatat

SEQ ID NO: 234559 - DNA, 24 bp, Artificial sequence
  SiRNA target sequence
tctaatattgttctgccttatatg

SEQ ID NO: 234560 - DNA, 24 bp, Artificial sequence
  SiRNA target sequence
ctaatattgttctgccttatatgg

SEQ ID NO: 234561 - DNA, 24 bp, Artificial sequence
  SiRNA target sequence
taatattgttctgccttatatggt

SEQ ID NO: 234562 - DNA, 24 bp, Artificial sequence
  SiRNA target sequence
aatattgttctgccttatatggtt

SEQ ID NO: 234563 - DNA, 24 bp, Artificial sequence
  SiRNA target sequence
atattgttctgccttatatggttt

SEQ ID NO: 234564 - DNA, 24 bp, Artificial sequence
  SiRNA target sequence
tattgttctgccttatatggtttt

SEQ ID NO: 234565 - DNA, 24 bp, Artificial sequence
  SiRNA target sequence
attgttctgccttatatggtttta

SEQ ID NO: 234566 - DNA, 24 bp, Artificial sequence
  SiRNA target sequence
ttgttctgccttatatggttttat

SEQ ID NO: 234567 - DNA, 24 bp, Artificial sequence
  SiRNA target sequence
tgttctgccttatatggttttatt

SEQ ID NO: 234568 - DNA, 24 bp, Artificial sequence
  SiRNA target sequence
gttctgccttatatggttttattc

SEQ ID NO: 234569 - DNA, 24 bp, Artificial sequence
  SiRNA target sequence
ttctgccttatatggttttattct

SEQ ID NO: 234570 - DNA, 24 bp, Artificial sequence
  SiRNA target sequence
tctgccttatatggttttattctg

SEQ ID NO: 234571 - DNA, 24 bp, Artificial sequence
  SiRNA target sequence
ctgccttatatggttttattctgt

SEQ ID NO: 234572 - DNA, 24 bp, Artificial sequence
  SiRNA target sequence
tgccttatatggttttattctgtt

SEQ ID NO: 234573 - DNA, 24 bp, Artificial sequence
  SiRNA target sequence
gccttatatggttttattctgttt

SEQ ID NO: 234574 - DNA, 24 bp, Artificial sequence
  SiRNA target sequence
ccttatatggttttattctgtttt

SEQ ID NO: 234575 - DNA, 24 bp, Artificial sequence
  SiRNA target sequence
cttatatggttttattctgttttc

SEQ ID NO: 234576 - DNA, 24 bp, Artificial sequence
  SiRNA target sequence
ttatatggttttattctgttttct

SEQ ID NO: 234577 - DNA, 24 bp, Artificial sequence
  SiRNA target sequence
tatatggttttattctgttttcta

SEQ ID NO: 234578 - DNA, 24 bp, Artificial sequence
  SiRNA target sequence
atatggttttattctgttttctat

SEQ ID NO: 234579 - DNA, 24 bp, Artificial sequence
  SiRNA target sequence
tatggttttattctgttttctatc

SEQ ID NO: 234580 - DNA, 24 bp, Artificial sequence
  SiRNA target sequence
atggttttattctgttttctatct

SEQ ID NO: 234581 - DNA, 24 bp, Artificial sequence
  SiRNA target sequence
tggttttattctgttttctatctc

SEQ ID NO: 234582 - DNA, 24 bp, Artificial sequence
  SiRNA target sequence
ggttttattctgttttctatctca

SEQ ID NO: 234583 - DNA, 24 bp, Artificial sequence
  SiRNA target sequence
gttttattctgttttctatctcaa

SEQ ID NO: 234584 - DNA, 24 bp, Artificial sequence
  SiRNA target sequence
ttttattctgttttctatctcaat

SEQ ID NO: 234585 - DNA, 24 bp, Artificial sequence
  SiRNA target sequence
tttattctgttttctatctcaata

SEQ ID NO: 234586 - DNA, 24 bp, Artificial sequence
  SiRNA target sequence
ttattctgttttctatctcaatag

SEQ ID NO: 234587 - DNA, 24 bp, Artificial sequence
  SiRNA target sequence
tattctgttttctatctcaataga

SEQ ID NO: 234588 - DNA, 24 bp, Artificial sequence
  SiRNA target sequence
attctgttttctatctcaatagaa

SEQ ID NO: 234589 - DNA, 24 bp, Artificial sequence
  SiRNA target sequence
ttctgttttctatctcaatagaaa

SEQ ID NO: 234590 - DNA, 24 bp, Artificial sequence
  SiRNA target sequence
tctgttttctatctcaatagaaaa

SEQ ID NO: 234591 - DNA, 24 bp, Artificial sequence
  SiRNA target sequence
ctgttttctatctcaatagaaaat

SEQ ID NO: 234592 - DNA, 24 bp, Artificial sequence
  SiRNA target sequence
tgttttctatctcaatagaaaata

SEQ ID NO: 234593 - DNA, 24 bp, Artificial sequence
  SiRNA target sequence
gttttctatctcaatagaaaatat

SEQ ID NO: 234594 - DNA, 24 bp, Artificial sequence
  SiRNA target sequence
ttttctatctcaatagaaaatata

SEQ ID NO: 234595 - DNA, 24 bp, Artificial sequence
  SiRNA target sequence
tttctatctcaatagaaaatataa

SEQ ID NO: 234596 - DNA, 24 bp, Artificial sequence
  SiRNA target sequence
ttctatctcaatagaaaatataaa

SEQ ID NO: 234597 - DNA, 24 bp, Artificial sequence
  SiRNA target sequence
tctatctcaatagaaaatataaag

SEQ ID NO: 234598 - DNA, 24 bp, Artificial sequence
  SiRNA target sequence
ctatctcaatagaaaatataaaga

SEQ ID NO: 234599 - DNA, 24 bp, Artificial sequence
  SiRNA target sequence
tatctcaatagaaaatataaagaa

SEQ ID NO: 234600 - DNA, 24 bp, Artificial sequence
  SiRNA target sequence
atctcaatagaaaatataaagaat

SEQ ID NO: 234601 - DNA, 24 bp, Artificial sequence
  SiRNA target sequence
tctcaatagaaaatataaagaatc

SEQ ID NO: 234602 - DNA, 24 bp, Artificial sequence
  SiRNA target sequence
ctcaatagaaaatataaagaatct

SEQ ID NO: 234603 - DNA, 24 bp, Artificial sequence
  SiRNA target sequence
tcaatagaaaatataaagaatctg

SEQ ID NO: 234604 - DNA, 24 bp, Artificial sequence
  SiRNA target sequence
caatagaaaatataaagaatctgt

SEQ ID NO: 234605 - DNA, 24 bp, Artificial sequence
  SiRNA target sequence
aatagaaaatataaagaatctgtc

SEQ ID NO: 234606 - DNA, 24 bp, Artificial sequence
  SiRNA target sequence
atagaaaatataaagaatctgtcg

SEQ ID NO: 234607 - DNA, 24 bp, Artificial sequence
  SiRNA target sequence
tagaaaatataaagaatctgtcga

SEQ ID NO: 234608 - DNA, 24 bp, Artificial sequence
  SiRNA target sequence
agaaaatataaagaatctgtcgag

SEQ ID NO: 234609 - DNA, 24 bp, Artificial sequence
  SiRNA target sequence
gaaaatataaagaatctgtcgaga

SEQ ID NO: 234610 - DNA, 24 bp, Artificial sequence
  SiRNA target sequence
aaaatataaagaatctgtcgagaa

SEQ ID NO: 234611 - DNA, 24 bp, Artificial sequence
  SiRNA target sequence
aaatataaagaatctgtcgagaat

SEQ ID NO: 234612 - DNA, 24 bp, Artificial sequence
  SiRNA target sequence
aatataaagaatctgtcgagaata

SEQ ID NO: 234613 - DNA, 24 bp, Artificial sequence
  SiRNA target sequence
atataaagaatctgtcgagaataa

SEQ ID NO: 234614 - DNA, 24 bp, Artificial sequence
  SiRNA target sequence
tataaagaatctgtcgagaataat

SEQ ID NO: 234615 - DNA, 24 bp, Artificial sequence
  SiRNA target sequence
ataaagaatctgtcgagaataatg

SEQ ID NO: 234616 - DNA, 24 bp, Artificial sequence
  SiRNA target sequence
taaagaatctgtcgagaataatgc

SEQ ID NO: 234617 - DNA, 24 bp, Artificial sequence
  SiRNA target sequence
aaagaatctgtcgagaataatgca

SEQ ID NO: 234618 - DNA, 24 bp, Artificial sequence
  SiRNA target sequence
aagaatctgtcgagaataatgcac

SEQ ID NO: 234619 - DNA, 24 bp, Artificial sequence
  SiRNA target sequence
agaatctgtcgagaataatgcacc

SEQ ID NO: 234620 - DNA, 24 bp, Artificial sequence
  SiRNA target sequence
gaatctgtcgagaataatgcacca

SEQ ID NO: 234621 - DNA, 24 bp, Artificial sequence
  SiRNA target sequence
aatctgtcgagaataatgcaccaa

SEQ ID NO: 234622 - DNA, 24 bp, Artificial sequence
  SiRNA target sequence
atctgtcgagaataatgcaccaat

SEQ ID NO: 234623 - DNA, 24 bp, Artificial sequence
  SiRNA target sequence
tctgtcgagaataatgcaccaatt

SEQ ID NO: 234624 - DNA, 24 bp, Artificial sequence
  SiRNA target sequence
ctgtcgagaataatgcaccaattg

SEQ ID NO: 234625 - DNA, 24 bp, Artificial sequence
  SiRNA target sequence
tgtcgagaataatgcaccaattga

SEQ ID NO: 234626 - DNA, 24 bp, Artificial sequence
  SiRNA target sequence
gtcgagaataatgcaccaattgat

SEQ ID NO: 234627 - DNA, 24 bp, Artificial sequence
  SiRNA target sequence
tcgagaataatgcaccaattgata

SEQ ID NO: 234628 - DNA, 24 bp, Artificial sequence
  SiRNA target sequence
cgagaataatgcaccaattgatat

SEQ ID NO: 234629 - DNA, 24 bp, Artificial sequence
  SiRNA target sequence
gagaataatgcaccaattgatatt

SEQ ID NO: 234630 - DNA, 24 bp, Artificial sequence
  SiRNA target sequence
agaataatgcaccaattgatattg

SEQ ID NO: 234631 - DNA, 24 bp, Artificial sequence
  SiRNA target sequence
gaataatgcaccaattgatattga

SEQ ID NO: 234632 - DNA, 24 bp, Artificial sequence
  SiRNA target sequence
aataatgcaccaattgatattgat

SEQ ID NO: 234633 - DNA, 24 bp, Artificial sequence
  SiRNA target sequence
ataatgcaccaattgatattgatt

SEQ ID NO: 234634 - DNA, 24 bp, Artificial sequence
  SiRNA target sequence
taatgcaccaattgatattgattt

SEQ ID NO: 234635 - DNA, 24 bp, Artificial sequence
  SiRNA target sequence
aatgcaccaattgatattgattta

SEQ ID NO: 234636 - DNA, 24 bp, Artificial sequence
  SiRNA target sequence
atgcaccaattgatattgatttat

SEQ ID NO: 234637 - DNA, 24 bp, Artificial sequence
  SiRNA target sequence
tgcaccaattgatattgatttatt

SEQ ID NO: 234638 - DNA, 24 bp, Artificial sequence
  SiRNA target sequence
gcaccaattgatattgatttattc

SEQ ID NO: 234639 - DNA, 24 bp, Artificial sequence
  SiRNA target sequence
caccaattgatattgatttattca

SEQ ID NO: 234640 - DNA, 24 bp, Artificial sequence
  SiRNA target sequence
accaattgatattgatttattcac

SEQ ID NO: 234641 - DNA, 24 bp, Artificial sequence
  SiRNA target sequence
ccaattgatattgatttattcact

SEQ ID NO: 234642 - DNA, 24 bp, Artificial sequence
  SiRNA target sequence
caattgatattgatttattcacta

SEQ ID NO: 234643 - DNA, 24 bp, Artificial sequence
  SiRNA target sequence
aattgatattgatttattcactag

SEQ ID NO: 234644 - DNA, 24 bp, Artificial sequence
  SiRNA target sequence
attgatattgatttattcactagt

SEQ ID NO: 234645 - DNA, 24 bp, Artificial sequence
  SiRNA target sequence
ttgatattgatttattcactagtt

SEQ ID NO: 234646 - DNA, 24 bp, Artificial sequence
  SiRNA target sequence
tgatattgatttattcactagttc

SEQ ID NO: 234647 - DNA, 24 bp, Artificial sequence
  SiRNA target sequence
gatattgatttattcactagttca

SEQ ID NO: 234648 - DNA, 24 bp, Artificial sequence
  SiRNA target sequence
atattgatttattcactagttcaa

SEQ ID NO: 234649 - DNA, 24 bp, Artificial sequence
  SiRNA target sequence
tattgatttattcactagttcaaa

SEQ ID NO: 234650 - DNA, 24 bp, Artificial sequence
  SiRNA target sequence
attgatttattcactagttcaaaa

SEQ ID NO: 234651 - DNA, 24 bp, Artificial sequence
  SiRNA target sequence
ttgatttattcactagttcaaaag

SEQ ID NO: 234652 - DNA, 24 bp, Artificial sequence
  SiRNA target sequence
tgatttattcactagttcaaaagt

SEQ ID NO: 234653 - DNA, 24 bp, Artificial sequence
  SiRNA target sequence
gatttattcactagttcaaaagtc

SEQ ID NO: 234654 - DNA, 24 bp, Artificial sequence
  SiRNA target sequence
atttattcactagttcaaaagtca

SEQ ID NO: 234655 - DNA, 24 bp, Artificial sequence
  SiRNA target sequence
tttattcactagttcaaaagtcaa

SEQ ID NO: 234656 - DNA, 24 bp, Artificial sequence
  SiRNA target sequence
ttattcactagttcaaaagtcaag

SEQ ID NO: 234657 - DNA, 24 bp, Artificial sequence
  SiRNA target sequence
tattcactagttcaaaagtcaagg

SEQ ID NO: 234658 - DNA, 24 bp, Artificial sequence
  SiRNA target sequence
attcactagttcaaaagtcaaggc

SEQ ID NO: 234659 - DNA, 24 bp, Artificial sequence
  SiRNA target sequence
ttcactagttcaaaagtcaaggca

SEQ ID NO: 234660 - DNA, 24 bp, Artificial sequence
  SiRNA target sequence
tcactagttcaaaagtcaaggcac

SEQ ID NO: 234661 - DNA, 24 bp, Artificial sequence
  SiRNA target sequence
cactagttcaaaagtcaaggcacc

SEQ ID NO: 234662 - DNA, 24 bp, Artificial sequence
  SiRNA target sequence
actagttcaaaagtcaaggcacct

SEQ ID NO: 234663 - DNA, 24 bp, Artificial sequence
  SiRNA target sequence
ctagttcaaaagtcaaggcacctt

SEQ ID NO: 234664 - DNA, 24 bp, Artificial sequence
  SiRNA target sequence
tagttcaaaagtcaaggcaccttc

SEQ ID NO: 234665 - DNA, 24 bp, Artificial sequence
  SiRNA target sequence
agttcaaaagtcaaggcaccttct

SEQ ID NO: 234666 - DNA, 24 bp, Artificial sequence
  SiRNA target sequence
gttcaaaagtcaaggcaccttctt

SEQ ID NO: 234667 - DNA, 24 bp, Artificial sequence
  SiRNA target sequence
ttcaaaagtcaaggcaccttcttc

SEQ ID NO: 234668 - DNA, 24 bp, Artificial sequence
  SiRNA target sequence
tcaaaagtcaaggcaccttcttct

SEQ ID NO: 234669 - DNA, 24 bp, Artificial sequence
  SiRNA target sequence
caaaagtcaaggcaccttcttctg

SEQ ID NO: 234670 - DNA, 24 bp, Artificial sequence
  SiRNA target sequence
aaaagtcaaggcaccttcttctga

SEQ ID NO: 234671 - DNA, 24 bp, Artificial sequence
  SiRNA target sequence
aaagtcaaggcaccttcttctgaa

SEQ ID NO: 234672 - DNA, 24 bp, Artificial sequence
  SiRNA target sequence
aagtcaaggcaccttcttctgaac

SEQ ID NO: 234673 - DNA, 24 bp, Artificial sequence
  SiRNA target sequence
agtcaaggcaccttcttctgaacc

SEQ ID NO: 234674 - DNA, 24 bp, Artificial sequence
  SiRNA target sequence
gtcaaggcaccttcttctgaacct

SEQ ID NO: 234675 - DNA, 24 bp, Artificial sequence
  SiRNA target sequence
tcaaggcaccttcttctgaaccta

SEQ ID NO: 234676 - DNA, 24 bp, Artificial sequence
  SiRNA target sequence
caaggcaccttcttctgaacctac

SEQ ID NO: 234677 - DNA, 24 bp, Artificial sequence
  SiRNA target sequence
aaggcaccttcttctgaacctact

SEQ ID NO: 234678 - DNA, 24 bp, Artificial sequence
  SiRNA target sequence
aggcaccttcttctgaacctactg

SEQ ID NO: 234679 - DNA, 24 bp, Artificial sequence
  SiRNA target sequence
ggcaccttcttctgaacctactgt

SEQ ID NO: 234680 - DNA, 24 bp, Artificial sequence
  SiRNA target sequence
gcaccttcttctgaacctactgtt

SEQ ID NO: 234681 - DNA, 24 bp, Artificial sequence
  SiRNA target sequence
caccttcttctgaacctactgttg

SEQ ID NO: 234682 - DNA, 24 bp, Artificial sequence
  SiRNA target sequence
accttcttctgaacctactgttgc

SEQ ID NO: 234683 - DNA, 24 bp, Artificial sequence
  SiRNA target sequence
ccttcttctgaacctactgttgct

SEQ ID NO: 234684 - DNA, 24 bp, Artificial sequence
  SiRNA target sequence
cttcttctgaacctactgttgcta

SEQ ID NO: 234685 - DNA, 24 bp, Artificial sequence
  SiRNA target sequence
ttcttctgaacctactgttgctac

SEQ ID NO: 234686 - DNA, 24 bp, Artificial sequence
  SiRNA target sequence
tcttctgaacctactgttgctacc

SEQ ID NO: 234687 - DNA, 24 bp, Artificial sequence
  SiRNA target sequence
cttctgaacctactgttgctacca

SEQ ID NO: 234688 - DNA, 24 bp, Artificial sequence
  SiRNA target sequence
ttctgaacctactgttgctaccaa

SEQ ID NO: 234689 - DNA, 24 bp, Artificial sequence
  SiRNA target sequence
tctgaacctactgttgctaccaaa

SEQ ID NO: 234690 - DNA, 24 bp, Artificial sequence
  SiRNA target sequence
ctgaacctactgttgctaccaaaa

SEQ ID NO: 234691 - DNA, 24 bp, Artificial sequence
  SiRNA target sequence
tgaacctactgttgctaccaaaag

SEQ ID NO: 234692 - DNA, 24 bp, Artificial sequence
  SiRNA target sequence
gaacctactgttgctaccaaaagt

SEQ ID NO: 234693 - DNA, 24 bp, Artificial sequence
  SiRNA target sequence
aacctactgttgctaccaaaagtg

SEQ ID NO: 234694 - DNA, 24 bp, Artificial sequence
  SiRNA target sequence
acctactgttgctaccaaaagtgt

SEQ ID NO: 234695 - DNA, 24 bp, Artificial sequence
  SiRNA target sequence
cctactgttgctaccaaaagtgtt

SEQ ID NO: 234696 - DNA, 24 bp, Artificial sequence
  SiRNA target sequence
ctactgttgctaccaaaagtgtta

SEQ ID NO: 234697 - DNA, 24 bp, Artificial sequence
  SiRNA target sequence
tactgttgctaccaaaagtgttac

SEQ ID NO: 234698 - DNA, 24 bp, Artificial sequence
  SiRNA target sequence
actgttgctaccaaaagtgttact

SEQ ID NO: 234699 - DNA, 24 bp, Artificial sequence
  SiRNA target sequence
ctgttgctaccaaaagtgttacta

SEQ ID NO: 234700 - DNA, 24 bp, Artificial sequence
  SiRNA target sequence
tgttgctaccaaaagtgttactac

SEQ ID NO: 234701 - DNA, 24 bp, Artificial sequence
  SiRNA target sequence
gttgctaccaaaagtgttactaca

SEQ ID NO: 234702 - DNA, 24 bp, Artificial sequence
  SiRNA target sequence
ttgctaccaaaagtgttactacag

SEQ ID NO: 234703 - DNA, 24 bp, Artificial sequence
  SiRNA target sequence
tgctaccaaaagtgttactacaga

SEQ ID NO: 234704 - DNA, 24 bp, Artificial sequence
  SiRNA target sequence
gctaccaaaagtgttactacagaa

SEQ ID NO: 234705 - DNA, 24 bp, Artificial sequence
  SiRNA target sequence
ctaccaaaagtgttactacagaag

SEQ ID NO: 234706 - DNA, 24 bp, Artificial sequence
  SiRNA target sequence
taccaaaagtgttactacagaaga

SEQ ID NO: 234707 - DNA, 24 bp, Artificial sequence
  SiRNA target sequence
accaaaagtgttactacagaagaa

SEQ ID NO: 234708 - DNA, 24 bp, Artificial sequence
  SiRNA target sequence
ccaaaagtgttactacagaagaat

SEQ ID NO: 234709 - DNA, 24 bp, Artificial sequence
  SiRNA target sequence
caaaagtgttactacagaagaata

SEQ ID NO: 234710 - DNA, 24 bp, Artificial sequence
  SiRNA target sequence
aaaagtgttactacagaagaataa

SEQ ID NO: 234711 - DNA, 25 bp, Artificial sequence
  SiRNA target sequence
atgtcagtagacaattcgaaagttc

SEQ ID NO: 234712 - DNA, 25 bp, Artificial sequence
  SiRNA target sequence
tgtcagtagacaattcgaaagttct

SEQ ID NO: 234713 - DNA, 25 bp, Artificial sequence
  SiRNA target sequence
gtcagtagacaattcgaaagttcta

SEQ ID NO: 234714 - DNA, 25 bp, Artificial sequence
  SiRNA target sequence
tcagtagacaattcgaaagttctac

SEQ ID NO: 234715 - DNA, 25 bp, Artificial sequence
  SiRNA target sequence
cagtagacaattcgaaagttctaca

SEQ ID NO: 234716 - DNA, 25 bp, Artificial sequence
  SiRNA target sequence
agtagacaattcgaaagttctacaa

SEQ ID NO: 234717 - DNA, 25 bp, Artificial sequence
  SiRNA target sequence
gtagacaattcgaaagttctacaaa

SEQ ID NO: 234718 - DNA, 25 bp, Artificial sequence
  SiRNA target sequence
tagacaattcgaaagttctacaaaa

SEQ ID NO: 234719 - DNA, 25 bp, Artificial sequence
  SiRNA target sequence
agacaattcgaaagttctacaaaat

SEQ ID NO: 234720 - DNA, 25 bp, Artificial sequence
  SiRNA target sequence
gacaattcgaaagttctacaaaata

SEQ ID NO: 234721 - DNA, 25 bp, Artificial sequence
  SiRNA target sequence
acaattcgaaagttctacaaaataa

SEQ ID NO: 234722 - DNA, 25 bp, Artificial sequence
  SiRNA target sequence
caattcgaaagttctacaaaataac

SEQ ID NO: 234723 - DNA, 25 bp, Artificial sequence
  SiRNA target sequence
aattcgaaagttctacaaaataacg

SEQ ID NO: 234724 - DNA, 25 bp, Artificial sequence
  SiRNA target sequence
attcgaaagttctacaaaataacga

SEQ ID NO: 234725 - DNA, 25 bp, Artificial sequence
  SiRNA target sequence
ttcgaaagttctacaaaataacgaa

SEQ ID NO: 234726 - DNA, 25 bp, Artificial sequence
  SiRNA target sequence
tcgaaagttctacaaaataacgaaa

SEQ ID NO: 234727 - DNA, 25 bp, Artificial sequence
  SiRNA target sequence
cgaaagttctacaaaataacgaaaa

SEQ ID NO: 234728 - DNA, 25 bp, Artificial sequence
  SiRNA target sequence
gaaagttctacaaaataacgaaaac

SEQ ID NO: 234729 - DNA, 25 bp, Artificial sequence
  SiRNA target sequence
aaagttctacaaaataacgaaaact

SEQ ID NO: 234730 - DNA, 25 bp, Artificial sequence
  SiRNA target sequence
aagttctacaaaataacgaaaactc

SEQ ID NO: 234731 - DNA, 25 bp, Artificial sequence
  SiRNA target sequence
agttctacaaaataacgaaaactct

SEQ ID NO: 234732 - DNA, 25 bp, Artificial sequence
  SiRNA target sequence
gttctacaaaataacgaaaactctg

SEQ ID NO: 234733 - DNA, 25 bp, Artificial sequence
  SiRNA target sequence
ttctacaaaataacgaaaactctgc

SEQ ID NO: 234734 - DNA, 25 bp, Artificial sequence
  SiRNA target sequence
tctacaaaataacgaaaactctgct

SEQ ID NO: 234735 - DNA, 25 bp, Artificial sequence
  SiRNA target sequence
ctacaaaataacgaaaactctgctc

SEQ ID NO: 234736 - DNA, 25 bp, Artificial sequence
  SiRNA target sequence
tacaaaataacgaaaactctgctct

SEQ ID NO: 234737 - DNA, 25 bp, Artificial sequence
  SiRNA target sequence
acaaaataacgaaaactctgctctt

SEQ ID NO: 234738 - DNA, 25 bp, Artificial sequence
  SiRNA target sequence
caaaataacgaaaactctgctcttc

SEQ ID NO: 234739 - DNA, 25 bp, Artificial sequence
  SiRNA target sequence
aaaataacgaaaactctgctcttcc

SEQ ID NO: 234740 - DNA, 25 bp, Artificial sequence
  SiRNA target sequence
aaataacgaaaactctgctcttcct

SEQ ID NO: 234741 - DNA, 25 bp, Artificial sequence
  SiRNA target sequence
aataacgaaaactctgctcttccta

SEQ ID NO: 234742 - DNA, 25 bp, Artificial sequence
  SiRNA target sequence
ataacgaaaactctgctcttcctac

SEQ ID NO: 234743 - DNA, 25 bp, Artificial sequence
  SiRNA target sequence
taacgaaaactctgctcttcctaca

SEQ ID NO: 234744 - DNA, 25 bp, Artificial sequence
  SiRNA target sequence
aacgaaaactctgctcttcctacag

SEQ ID NO: 234745 - DNA, 25 bp, Artificial sequence
  SiRNA target sequence
acgaaaactctgctcttcctacaga

SEQ ID NO: 234746 - DNA, 25 bp, Artificial sequence
  SiRNA target sequence
cgaaaactctgctcttcctacagaa

SEQ ID NO: 234747 - DNA, 25 bp, Artificial sequence
  SiRNA target sequence
gaaaactctgctcttcctacagaag

SEQ ID NO: 234748 - DNA, 25 bp, Artificial sequence
  SiRNA target sequence
aaaactctgctcttcctacagaaga

SEQ ID NO: 234749 - DNA, 25 bp, Artificial sequence
  SiRNA target sequence
aaactctgctcttcctacagaagat

SEQ ID NO: 234750 - DNA, 25 bp, Artificial sequence
  SiRNA target sequence
aactctgctcttcctacagaagatg

SEQ ID NO: 234751 - DNA, 25 bp, Artificial sequence
  SiRNA target sequence
actctgctcttcctacagaagatga

SEQ ID NO: 234752 - DNA, 25 bp, Artificial sequence
  SiRNA target sequence
ctctgctcttcctacagaagatgaa

SEQ ID NO: 234753 - DNA, 25 bp, Artificial sequence
  SiRNA target sequence
tctgctcttcctacagaagatgaaa

SEQ ID NO: 234754 - DNA, 25 bp, Artificial sequence
  SiRNA target sequence
ctgctcttcctacagaagatgaaat

SEQ ID NO: 234755 - DNA, 25 bp, Artificial sequence
  SiRNA target sequence
tgctcttcctacagaagatgaaatt

SEQ ID NO: 234756 - DNA, 25 bp, Artificial sequence
  SiRNA target sequence
gctcttcctacagaagatgaaattg

SEQ ID NO: 234757 - DNA, 25 bp, Artificial sequence
  SiRNA target sequence
ctcttcctacagaagatgaaattga

SEQ ID NO: 234758 - DNA, 25 bp, Artificial sequence
  SiRNA target sequence
tcttcctacagaagatgaaattgag

SEQ ID NO: 234759 - DNA, 25 bp, Artificial sequence
  SiRNA target sequence
cttcctacagaagatgaaattgagt

SEQ ID NO: 234760 - DNA, 25 bp, Artificial sequence
  SiRNA target sequence
ttcctacagaagatgaaattgagta

SEQ ID NO: 234761 - DNA, 25 bp, Artificial sequence
  SiRNA target sequence
tcctacagaagatgaaattgagtat

SEQ ID NO: 234762 - DNA, 25 bp, Artificial sequence
  SiRNA target sequence
cctacagaagatgaaattgagtatg

SEQ ID NO: 234763 - DNA, 25 bp, Artificial sequence
  SiRNA target sequence
ctacagaagatgaaattgagtatga

SEQ ID NO: 234764 - DNA, 25 bp, Artificial sequence
  SiRNA target sequence
tacagaagatgaaattgagtatgag

SEQ ID NO: 234765 - DNA, 25 bp, Artificial sequence
  SiRNA target sequence
acagaagatgaaattgagtatgagg

SEQ ID NO: 234766 - DNA, 25 bp, Artificial sequence
  SiRNA target sequence
cagaagatgaaattgagtatgaggc

SEQ ID NO: 234767 - DNA, 25 bp, Artificial sequence
  SiRNA target sequence
agaagatgaaattgagtatgaggcc

SEQ ID NO: 234768 - DNA, 25 bp, Artificial sequence
  SiRNA target sequence
gaagatgaaattgagtatgaggcca

SEQ ID NO: 234769 - DNA, 25 bp, Artificial sequence
  SiRNA target sequence
aagatgaaattgagtatgaggccag

SEQ ID NO: 234770 - DNA, 25 bp, Artificial sequence
  SiRNA target sequence
agatgaaattgagtatgaggccagc

SEQ ID NO: 234771 - DNA, 25 bp, Artificial sequence
  SiRNA target sequence
gatgaaattgagtatgaggccagca

SEQ ID NO: 234772 - DNA, 25 bp, Artificial sequence
  SiRNA target sequence
atgaaattgagtatgaggccagcaa

SEQ ID NO: 234773 - DNA, 25 bp, Artificial sequence
  SiRNA target sequence
tgaaattgagtatgaggccagcaat

SEQ ID NO: 234774 - DNA, 25 bp, Artificial sequence
  SiRNA target sequence
gaaattgagtatgaggccagcaatg

SEQ ID NO: 234775 - DNA, 25 bp, Artificial sequence
  SiRNA target sequence
aaattgagtatgaggccagcaatgg

SEQ ID NO: 234776 - DNA, 25 bp, Artificial sequence
  SiRNA target sequence
aattgagtatgaggccagcaatggt

SEQ ID NO: 234777 - DNA, 25 bp, Artificial sequence
  SiRNA target sequence
attgagtatgaggccagcaatggtt

SEQ ID NO: 234778 - DNA, 25 bp, Artificial sequence
  SiRNA target sequence
ttgagtatgaggccagcaatggttc

SEQ ID NO: 234779 - DNA, 25 bp, Artificial sequence
  SiRNA target sequence
tgagtatgaggccagcaatggttct

SEQ ID NO: 234780 - DNA, 25 bp, Artificial sequence
  SiRNA target sequence
gagtatgaggccagcaatggttctg

SEQ ID NO: 234781 - DNA, 25 bp, Artificial sequence
  SiRNA target sequence
agtatgaggccagcaatggttctgg

SEQ ID NO: 234782 - DNA, 25 bp, Artificial sequence
  SiRNA target sequence
gtatgaggccagcaatggttctggt

SEQ ID NO: 234783 - DNA, 25 bp, Artificial sequence
  SiRNA target sequence
tatgaggccagcaatggttctggta

SEQ ID NO: 234784 - DNA, 25 bp, Artificial sequence
  SiRNA target sequence
atgaggccagcaatggttctggtat

SEQ ID NO: 234785 - DNA, 25 bp, Artificial sequence
  SiRNA target sequence
tgaggccagcaatggttctggtata

SEQ ID NO: 234786 - DNA, 25 bp, Artificial sequence
  SiRNA target sequence
gaggccagcaatggttctggtatat

SEQ ID NO: 234787 - DNA, 25 bp, Artificial sequence
  SiRNA target sequence
aggccagcaatggttctggtatata

SEQ ID NO: 234788 - DNA, 25 bp, Artificial sequence
  SiRNA target sequence
ggccagcaatggttctggtatatat

SEQ ID NO: 234789 - DNA, 25 bp, Artificial sequence
  SiRNA target sequence
gccagcaatggttctggtatatatt

SEQ ID NO: 234790 - DNA, 25 bp, Artificial sequence
  SiRNA target sequence
ccagcaatggttctggtatatattc

SEQ ID NO: 234791 - DNA, 25 bp, Artificial sequence
  SiRNA target sequence
cagcaatggttctggtatatattca

SEQ ID NO: 234792 - DNA, 25 bp, Artificial sequence
  SiRNA target sequence
agcaatggttctggtatatattcac

SEQ ID NO: 234793 - DNA, 25 bp, Artificial sequence
  SiRNA target sequence
gcaatggttctggtatatattcact

SEQ ID NO: 234794 - DNA, 25 bp, Artificial sequence
  SiRNA target sequence
caatggttctggtatatattcactt

SEQ ID NO: 234795 - DNA, 25 bp, Artificial sequence
  SiRNA target sequence
aatggttctggtatatattcactta

SEQ ID NO: 234796 - DNA, 25 bp, Artificial sequence
  SiRNA target sequence
atggttctggtatatattcacttat

SEQ ID NO: 234797 - DNA, 25 bp, Artificial sequence
  SiRNA target sequence
tggttctggtatatattcacttatt

SEQ ID NO: 234798 - DNA, 25 bp, Artificial sequence
  SiRNA target sequence
ggttctggtatatattcacttatta

SEQ ID NO: 234799 - DNA, 25 bp, Artificial sequence
  SiRNA target sequence
gttctggtatatattcacttattag

SEQ ID NO: 234800 - DNA, 25 bp, Artificial sequence
  SiRNA target sequence
ttctggtatatattcacttattaga

SEQ ID NO: 234801 - DNA, 25 bp, Artificial sequence
  SiRNA target sequence
tctggtatatattcacttattagag

SEQ ID NO: 234802 - DNA, 25 bp, Artificial sequence
  SiRNA target sequence
ctggtatatattcacttattagagt

SEQ ID NO: 234803 - DNA, 25 bp, Artificial sequence
  SiRNA target sequence
tggtatatattcacttattagagta

SEQ ID NO: 234804 - DNA, 25 bp, Artificial sequence
  SiRNA target sequence
ggtatatattcacttattagagtag

SEQ ID NO: 234805 - DNA, 25 bp, Artificial sequence
  SiRNA target sequence
gtatatattcacttattagagtagc

SEQ ID NO: 234806 - DNA, 25 bp, Artificial sequence
  SiRNA target sequence
tatatattcacttattagagtagca

SEQ ID NO: 234807 - DNA, 25 bp, Artificial sequence
  SiRNA target sequence
atatattcacttattagagtagcaa

SEQ ID NO: 234808 - DNA, 25 bp, Artificial sequence
  SiRNA target sequence
tatattcacttattagagtagcaaa

SEQ ID NO: 234809 - DNA, 25 bp, Artificial sequence
  SiRNA target sequence
atattcacttattagagtagcaaag

SEQ ID NO: 234810 - DNA, 25 bp, Artificial sequence
  SiRNA target sequence
tattcacttattagagtagcaaagg

SEQ ID NO: 234811 - DNA, 25 bp, Artificial sequence
  SiRNA target sequence
attcacttattagagtagcaaaggt

SEQ ID NO: 234812 - DNA, 25 bp, Artificial sequence
  SiRNA target sequence
ttcacttattagagtagcaaaggtt

SEQ ID NO: 234813 - DNA, 25 bp, Artificial sequence
  SiRNA target sequence
tcacttattagagtagcaaaggttg

SEQ ID NO: 234814 - DNA, 25 bp, Artificial sequence
  SiRNA target sequence
cacttattagagtagcaaaggttga

SEQ ID NO: 234815 - DNA, 25 bp, Artificial sequence
  SiRNA target sequence
acttattagagtagcaaaggttgag

SEQ ID NO: 234816 - DNA, 25 bp, Artificial sequence
  SiRNA target sequence
cttattagagtagcaaaggttgaga

SEQ ID NO: 234817 - DNA, 25 bp, Artificial sequence
  SiRNA target sequence
ttattagagtagcaaaggttgagag

SEQ ID NO: 234818 - DNA, 25 bp, Artificial sequence
  SiRNA target sequence
tattagagtagcaaaggttgagaga

SEQ ID NO: 234819 - DNA, 25 bp, Artificial sequence
  SiRNA target sequence
attagagtagcaaaggttgagagaa

SEQ ID NO: 234820 - DNA, 25 bp, Artificial sequence
  SiRNA target sequence
ttagagtagcaaaggttgagagaaa

SEQ ID NO: 234821 - DNA, 25 bp, Artificial sequence
  SiRNA target sequence
tagagtagcaaaggttgagagaaag

SEQ ID NO: 234822 - DNA, 25 bp, Artificial sequence
  SiRNA target sequence
agagtagcaaaggttgagagaaaga

SEQ ID NO: 234823 - DNA, 25 bp, Artificial sequence
  SiRNA target sequence
gagtagcaaaggttgagagaaagat

SEQ ID NO: 234824 - DNA, 25 bp, Artificial sequence
  SiRNA target sequence
agtagcaaaggttgagagaaagatg

SEQ ID NO: 234825 - DNA, 25 bp, Artificial sequence
  SiRNA target sequence
gtagcaaaggttgagagaaagatgt

SEQ ID NO: 234826 - DNA, 25 bp, Artificial sequence
  SiRNA target sequence
tagcaaaggttgagagaaagatgtt

SEQ ID NO: 234827 - DNA, 25 bp, Artificial sequence
  SiRNA target sequence
agcaaaggttgagagaaagatgttt

SEQ ID NO: 234828 - DNA, 25 bp, Artificial sequence
  SiRNA target sequence
gcaaaggttgagagaaagatgtttt

SEQ ID NO: 234829 - DNA, 25 bp, Artificial sequence
  SiRNA target sequence
caaaggttgagagaaagatgttttg

SEQ ID NO: 234830 - DNA, 25 bp, Artificial sequence
  SiRNA target sequence
aaaggttgagagaaagatgttttgg

SEQ ID NO: 234831 - DNA, 25 bp, Artificial sequence
  SiRNA target sequence
aaggttgagagaaagatgttttgga

SEQ ID NO: 234832 - DNA, 25 bp, Artificial sequence
  SiRNA target sequence
aggttgagagaaagatgttttggat

SEQ ID NO: 234833 - DNA, 25 bp, Artificial sequence
  SiRNA target sequence
ggttgagagaaagatgttttggatc

SEQ ID NO: 234834 - DNA, 25 bp, Artificial sequence
  SiRNA target sequence
gttgagagaaagatgttttggatca

SEQ ID NO: 234835 - DNA, 25 bp, Artificial sequence
  SiRNA target sequence
ttgagagaaagatgttttggatcat

SEQ ID NO: 234836 - DNA, 25 bp, Artificial sequence
  SiRNA target sequence
tgagagaaagatgttttggatcatg

SEQ ID NO: 234837 - DNA, 25 bp, Artificial sequence
  SiRNA target sequence
gagagaaagatgttttggatcatgg

SEQ ID NO: 234838 - DNA, 25 bp, Artificial sequence
  SiRNA target sequence
agagaaagatgttttggatcatggc

SEQ ID NO: 234839 - DNA, 25 bp, Artificial sequence
  SiRNA target sequence
gagaaagatgttttggatcatggca

SEQ ID NO: 234840 - DNA, 25 bp, Artificial sequence
  SiRNA target sequence
agaaagatgttttggatcatggcag

SEQ ID NO: 234841 - DNA, 25 bp, Artificial sequence
  SiRNA target sequence
gaaagatgttttggatcatggcagc

SEQ ID NO: 234842 - DNA, 25 bp, Artificial sequence
  SiRNA target sequence
aaagatgttttggatcatggcagct

SEQ ID NO: 234843 - DNA, 25 bp, Artificial sequence
  SiRNA target sequence
aagatgttttggatcatggcagcta

SEQ ID NO: 234844 - DNA, 25 bp, Artificial sequence
  SiRNA target sequence
agatgttttggatcatggcagctat

SEQ ID NO: 234845 - DNA, 25 bp, Artificial sequence
  SiRNA target sequence
gatgttttggatcatggcagctatg

SEQ ID NO: 234846 - DNA, 25 bp, Artificial sequence
  SiRNA target sequence
atgttttggatcatggcagctatgt

SEQ ID NO: 234847 - DNA, 25 bp, Artificial sequence
  SiRNA target sequence
tgttttggatcatggcagctatgtt

SEQ ID NO: 234848 - DNA, 25 bp, Artificial sequence
  SiRNA target sequence
gttttggatcatggcagctatgttc

SEQ ID NO: 234849 - DNA, 25 bp, Artificial sequence
  SiRNA target sequence
ttttggatcatggcagctatgttct

SEQ ID NO: 234850 - DNA, 25 bp, Artificial sequence
  SiRNA target sequence
tttggatcatggcagctatgttctt

SEQ ID NO: 234851 - DNA, 25 bp, Artificial sequence
  SiRNA target sequence
ttggatcatggcagctatgttcttt

SEQ ID NO: 234852 - DNA, 25 bp, Artificial sequence
  SiRNA target sequence
tggatcatggcagctatgttcttta

SEQ ID NO: 234853 - DNA, 25 bp, Artificial sequence
  SiRNA target sequence
ggatcatggcagctatgttctttat

SEQ ID NO: 234854 - DNA, 25 bp, Artificial sequence
  SiRNA target sequence
gatcatggcagctatgttctttatt

SEQ ID NO: 234855 - DNA, 25 bp, Artificial sequence
  SiRNA target sequence
atcatggcagctatgttctttatta

SEQ ID NO: 234856 - DNA, 25 bp, Artificial sequence
  SiRNA target sequence
tcatggcagctatgttctttattat

SEQ ID NO: 234857 - DNA, 25 bp, Artificial sequence
  SiRNA target sequence
catggcagctatgttctttattatc

SEQ ID NO: 234858 - DNA, 25 bp, Artificial sequence
  SiRNA target sequence
atggcagctatgttctttattatct

SEQ ID NO: 234859 - DNA, 25 bp, Artificial sequence
  SiRNA target sequence
tggcagctatgttctttattatctc

SEQ ID NO: 234860 - DNA, 25 bp, Artificial sequence
  SiRNA target sequence
ggcagctatgttctttattatctcc

SEQ ID NO: 234861 - DNA, 25 bp, Artificial sequence
  SiRNA target sequence
gcagctatgttctttattatctcct

SEQ ID NO: 234862 - DNA, 25 bp, Artificial sequence
  SiRNA target sequence
cagctatgttctttattatctcctt

SEQ ID NO: 234863 - DNA, 25 bp, Artificial sequence
  SiRNA target sequence
agctatgttctttattatctccttt

SEQ ID NO: 234864 - DNA, 25 bp, Artificial sequence
  SiRNA target sequence
gctatgttctttattatctccttta

SEQ ID NO: 234865 - DNA, 25 bp, Artificial sequence
  SiRNA target sequence
ctatgttctttattatctcctttat

SEQ ID NO: 234866 - DNA, 25 bp, Artificial sequence
  SiRNA target sequence
tatgttctttattatctcctttatt

SEQ ID NO: 234867 - DNA, 25 bp, Artificial sequence
  SiRNA target sequence
atgttctttattatctcctttattt

SEQ ID NO: 234868 - DNA, 25 bp, Artificial sequence
  SiRNA target sequence
tgttctttattatctcctttattta

SEQ ID NO: 234869 - DNA, 25 bp, Artificial sequence
  SiRNA target sequence
gttctttattatctcctttatttat

SEQ ID NO: 234870 - DNA, 25 bp, Artificial sequence
  SiRNA target sequence
ttctttattatctcctttatttatt

SEQ ID NO: 234871 - DNA, 25 bp, Artificial sequence
  SiRNA target sequence
tctttattatctcctttatttattc

SEQ ID NO: 234872 - DNA, 25 bp, Artificial sequence
  SiRNA target sequence
ctttattatctcctttatttattcg

SEQ ID NO: 234873 - DNA, 25 bp, Artificial sequence
  SiRNA target sequence
tttattatctcctttatttattcgg

SEQ ID NO: 234874 - DNA, 25 bp, Artificial sequence
  SiRNA target sequence
ttattatctcctttatttattcggt

SEQ ID NO: 234875 - DNA, 25 bp, Artificial sequence
  SiRNA target sequence
tattatctcctttatttattcggtg

SEQ ID NO: 234876 - DNA, 25 bp, Artificial sequence
  SiRNA target sequence
attatctcctttatttattcggtgg

SEQ ID NO: 234877 - DNA, 25 bp, Artificial sequence
  SiRNA target sequence
ttatctcctttatttattcggtggc

SEQ ID NO: 234878 - DNA, 25 bp, Artificial sequence
  SiRNA target sequence
tatctcctttatttattcggtggct

SEQ ID NO: 234879 - DNA, 25 bp, Artificial sequence
  SiRNA target sequence
atctcctttatttattcggtggcta

SEQ ID NO: 234880 - DNA, 25 bp, Artificial sequence
  SiRNA target sequence
tctcctttatttattcggtggctag

SEQ ID NO: 234881 - DNA, 25 bp, Artificial sequence
  SiRNA target sequence
ctcctttatttattcggtggctaga

SEQ ID NO: 234882 - DNA, 25 bp, Artificial sequence
  SiRNA target sequence
tcctttatttattcggtggctagag

SEQ ID NO: 234883 - DNA, 25 bp, Artificial sequence
  SiRNA target sequence
cctttatttattcggtggctagagt

SEQ ID NO: 234884 - DNA, 25 bp, Artificial sequence
  SiRNA target sequence
ctttatttattcggtggctagagtg

SEQ ID NO: 234885 - DNA, 25 bp, Artificial sequence
  SiRNA target sequence
tttatttattcggtggctagagtgc

SEQ ID NO: 234886 - DNA, 25 bp, Artificial sequence
  SiRNA target sequence
ttatttattcggtggctagagtgct

SEQ ID NO: 234887 - DNA, 25 bp, Artificial sequence
  SiRNA target sequence
tatttattcggtggctagagtgctt

SEQ ID NO: 234888 - DNA, 25 bp, Artificial sequence
  SiRNA target sequence
atttattcggtggctagagtgctta

SEQ ID NO: 234889 - DNA, 25 bp, Artificial sequence
  SiRNA target sequence
tttattcggtggctagagtgcttaa

SEQ ID NO: 234890 - DNA, 25 bp, Artificial sequence
  SiRNA target sequence
ttattcggtggctagagtgcttaaa

SEQ ID NO: 234891 - DNA, 25 bp, Artificial sequence
  SiRNA target sequence
tattcggtggctagagtgcttaaag

SEQ ID NO: 234892 - DNA, 25 bp, Artificial sequence
  SiRNA target sequence
attcggtggctagagtgcttaaaga

SEQ ID NO: 234893 - DNA, 25 bp, Artificial sequence
  SiRNA target sequence
ttcggtggctagagtgcttaaagat

SEQ ID NO: 234894 - DNA, 25 bp, Artificial sequence
  SiRNA target sequence
tcggtggctagagtgcttaaagatg

SEQ ID NO: 234895 - DNA, 25 bp, Artificial sequence
  SiRNA target sequence
cggtggctagagtgcttaaagatgc

SEQ ID NO: 234896 - DNA, 25 bp, Artificial sequence
  SiRNA target sequence
ggtggctagagtgcttaaagatgcc

SEQ ID NO: 234897 - DNA, 25 bp, Artificial sequence
  SiRNA target sequence
gtggctagagtgcttaaagatgccg

SEQ ID NO: 234898 - DNA, 25 bp, Artificial sequence
  SiRNA target sequence
tggctagagtgcttaaagatgccgc

SEQ ID NO: 234899 - DNA, 25 bp, Artificial sequence
  SiRNA target sequence
ggctagagtgcttaaagatgccgct

SEQ ID NO: 234900 - DNA, 25 bp, Artificial sequence
  SiRNA target sequence
gctagagtgcttaaagatgccgctg

SEQ ID NO: 234901 - DNA, 25 bp, Artificial sequence
  SiRNA target sequence
ctagagtgcttaaagatgccgctgt

SEQ ID NO: 234902 - DNA, 25 bp, Artificial sequence
  SiRNA target sequence
tagagtgcttaaagatgccgctgtt

SEQ ID NO: 234903 - DNA, 25 bp, Artificial sequence
  SiRNA target sequence
agagtgcttaaagatgccgctgtta

SEQ ID NO: 234904 - DNA, 25 bp, Artificial sequence
  SiRNA target sequence
gagtgcttaaagatgccgctgttat

SEQ ID NO: 234905 - DNA, 25 bp, Artificial sequence
  SiRNA target sequence
agtgcttaaagatgccgctgttatt

SEQ ID NO: 234906 - DNA, 25 bp, Artificial sequence
  SiRNA target sequence
gtgcttaaagatgccgctgttattg

SEQ ID NO: 234907 - DNA, 25 bp, Artificial sequence
  SiRNA target sequence
tgcttaaagatgccgctgttattgg

SEQ ID NO: 234908 - DNA, 25 bp, Artificial sequence
  SiRNA target sequence
gcttaaagatgccgctgttattggt

SEQ ID NO: 234909 - DNA, 25 bp, Artificial sequence
  SiRNA target sequence
cttaaagatgccgctgttattggta

SEQ ID NO: 234910 - DNA, 25 bp, Artificial sequence
  SiRNA target sequence
ttaaagatgccgctgttattggtaa

SEQ ID NO: 234911 - DNA, 25 bp, Artificial sequence
  SiRNA target sequence
taaagatgccgctgttattggtaaa

SEQ ID NO: 234912 - DNA, 25 bp, Artificial sequence
  SiRNA target sequence
aaagatgccgctgttattggtaaac

SEQ ID NO: 234913 - DNA, 25 bp, Artificial sequence
  SiRNA target sequence
aagatgccgctgttattggtaaaca

SEQ ID NO: 234914 - DNA, 25 bp, Artificial sequence
  SiRNA target sequence
agatgccgctgttattggtaaacaa

SEQ ID NO: 234915 - DNA, 25 bp, Artificial sequence
  SiRNA target sequence
gatgccgctgttattggtaaacaac

SEQ ID NO: 234916 - DNA, 25 bp, Artificial sequence
  SiRNA target sequence
atgccgctgttattggtaaacaact

SEQ ID NO: 234917 - DNA, 25 bp, Artificial sequence
  SiRNA target sequence
tgccgctgttattggtaaacaactc

SEQ ID NO: 234918 - DNA, 25 bp, Artificial sequence
  SiRNA target sequence
gccgctgttattggtaaacaactcc

SEQ ID NO: 234919 - DNA, 25 bp, Artificial sequence
  SiRNA target sequence
ccgctgttattggtaaacaactccc

SEQ ID NO: 234920 - DNA, 25 bp, Artificial sequence
  SiRNA target sequence
cgctgttattggtaaacaactccca

SEQ ID NO: 234921 - DNA, 25 bp, Artificial sequence
  SiRNA target sequence
gctgttattggtaaacaactcccag

SEQ ID NO: 234922 - DNA, 25 bp, Artificial sequence
  SiRNA target sequence
ctgttattggtaaacaactcccagc

SEQ ID NO: 234923 - DNA, 25 bp, Artificial sequence
  SiRNA target sequence
tgttattggtaaacaactcccagcg

SEQ ID NO: 234924 - DNA, 25 bp, Artificial sequence
  SiRNA target sequence
gttattggtaaacaactcccagcgt

SEQ ID NO: 234925 - DNA, 25 bp, Artificial sequence
  SiRNA target sequence
ttattggtaaacaactcccagcgtc

SEQ ID NO: 234926 - DNA, 25 bp, Artificial sequence
  SiRNA target sequence
tattggtaaacaactcccagcgtca

SEQ ID NO: 234927 - DNA, 25 bp, Artificial sequence
  SiRNA target sequence
attggtaaacaactcccagcgtcaa

SEQ ID NO: 234928 - DNA, 25 bp, Artificial sequence
  SiRNA target sequence
ttggtaaacaactcccagcgtcaat

SEQ ID NO: 234929 - DNA, 25 bp, Artificial sequence
  SiRNA target sequence
tggtaaacaactcccagcgtcaatt

SEQ ID NO: 234930 - DNA, 25 bp, Artificial sequence
  SiRNA target sequence
ggtaaacaactcccagcgtcaattt

SEQ ID NO: 234931 - DNA, 25 bp, Artificial sequence
  SiRNA target sequence
gtaaacaactcccagcgtcaatttt

SEQ ID NO: 234932 - DNA, 25 bp, Artificial sequence
  SiRNA target sequence
taaacaactcccagcgtcaattttc

SEQ ID NO: 234933 - DNA, 25 bp, Artificial sequence
  SiRNA target sequence
aaacaactcccagcgtcaattttct

SEQ ID NO: 234934 - DNA, 25 bp, Artificial sequence
  SiRNA target sequence
aacaactcccagcgtcaattttctt

SEQ ID NO: 234935 - DNA, 25 bp, Artificial sequence
  SiRNA target sequence
acaactcccagcgtcaattttcttt

SEQ ID NO: 234936 - DNA, 25 bp, Artificial sequence
  SiRNA target sequence
caactcccagcgtcaattttctttt

SEQ ID NO: 234937 - DNA, 25 bp, Artificial sequence
  SiRNA target sequence
aactcccagcgtcaattttcttttt

SEQ ID NO: 234938 - DNA, 25 bp, Artificial sequence
  SiRNA target sequence
actcccagcgtcaattttctttttg

SEQ ID NO: 234939 - DNA, 25 bp, Artificial sequence
  SiRNA target sequence
ctcccagcgtcaattttctttttga

SEQ ID NO: 234940 - DNA, 25 bp, Artificial sequence
  SiRNA target sequence
tcccagcgtcaattttctttttgaa

SEQ ID NO: 234941 - DNA, 25 bp, Artificial sequence
  SiRNA target sequence
cccagcgtcaattttctttttgaaa

SEQ ID NO: 234942 - DNA, 25 bp, Artificial sequence
  SiRNA target sequence
ccagcgtcaattttctttttgaaat

SEQ ID NO: 234943 - DNA, 25 bp, Artificial sequence
  SiRNA target sequence
cagcgtcaattttctttttgaaatt

SEQ ID NO: 234944 - DNA, 25 bp, Artificial sequence
  SiRNA target sequence
agcgtcaattttctttttgaaattt

SEQ ID NO: 234945 - DNA, 25 bp, Artificial sequence
  SiRNA target sequence
gcgtcaattttctttttgaaatttg

SEQ ID NO: 234946 - DNA, 25 bp, Artificial sequence
  SiRNA target sequence
cgtcaattttctttttgaaatttgt

SEQ ID NO: 234947 - DNA, 25 bp, Artificial sequence
  SiRNA target sequence
gtcaattttctttttgaaatttgtt

SEQ ID NO: 234948 - DNA, 25 bp, Artificial sequence
  SiRNA target sequence
tcaattttctttttgaaatttgtta

SEQ ID NO: 234949 - DNA, 25 bp, Artificial sequence
  SiRNA target sequence
caattttctttttgaaatttgttat

SEQ ID NO: 234950 - DNA, 25 bp, Artificial sequence
  SiRNA target sequence
aattttctttttgaaatttgttatt

SEQ ID NO: 234951 - DNA, 25 bp, Artificial sequence
  SiRNA target sequence
attttctttttgaaatttgttatta

SEQ ID NO: 234952 - DNA, 25 bp, Artificial sequence
  SiRNA target sequence
ttttctttttgaaatttgttattat

SEQ ID NO: 234953 - DNA, 25 bp, Artificial sequence
  SiRNA target sequence
tttctttttgaaatttgttattatc

SEQ ID NO: 234954 - DNA, 25 bp, Artificial sequence
  SiRNA target sequence
ttctttttgaaatttgttattatcc

SEQ ID NO: 234955 - DNA, 25 bp, Artificial sequence
  SiRNA target sequence
tctttttgaaatttgttattatcct

SEQ ID NO: 234956 - DNA, 25 bp, Artificial sequence
  SiRNA target sequence
ctttttgaaatttgttattatcctt

SEQ ID NO: 234957 - DNA, 25 bp, Artificial sequence
  SiRNA target sequence
tttttgaaatttgttattatccttc

SEQ ID NO: 234958 - DNA, 25 bp, Artificial sequence
  SiRNA target sequence
ttttgaaatttgttattatccttcc

SEQ ID NO: 234959 - DNA, 25 bp, Artificial sequence
  SiRNA target sequence
tttgaaatttgttattatccttccg

SEQ ID NO: 234960 - DNA, 25 bp, Artificial sequence
  SiRNA target sequence
ttgaaatttgttattatccttccgt

SEQ ID NO: 234961 - DNA, 25 bp, Artificial sequence
  SiRNA target sequence
tgaaatttgttattatccttccgtt

SEQ ID NO: 234962 - DNA, 25 bp, Artificial sequence
  SiRNA target sequence
gaaatttgttattatccttccgttc

SEQ ID NO: 234963 - DNA, 25 bp, Artificial sequence
  SiRNA target sequence
aaatttgttattatccttccgttct

SEQ ID NO: 234964 - DNA, 25 bp, Artificial sequence
  SiRNA target sequence
aatttgttattatccttccgttctc

SEQ ID NO: 234965 - DNA, 25 bp, Artificial sequence
  SiRNA target sequence
atttgttattatccttccgttctca

SEQ ID NO: 234966 - DNA, 25 bp, Artificial sequence
  SiRNA target sequence
tttgttattatccttccgttctcat

SEQ ID NO: 234967 - DNA, 25 bp, Artificial sequence
  SiRNA target sequence
ttgttattatccttccgttctcatt

SEQ ID NO: 234968 - DNA, 25 bp, Artificial sequence
  SiRNA target sequence
tgttattatccttccgttctcattt

SEQ ID NO: 234969 - DNA, 25 bp, Artificial sequence
  SiRNA target sequence
gttattatccttccgttctcattta

SEQ ID NO: 234970 - DNA, 25 bp, Artificial sequence
  SiRNA target sequence
ttattatccttccgttctcatttat

SEQ ID NO: 234971 - DNA, 25 bp, Artificial sequence
  SiRNA target sequence
tattatccttccgttctcatttatt

SEQ ID NO: 234972 - DNA, 25 bp, Artificial sequence
  SiRNA target sequence
attatccttccgttctcatttattt

SEQ ID NO: 234973 - DNA, 25 bp, Artificial sequence
  SiRNA target sequence
ttatccttccgttctcatttatttc

SEQ ID NO: 234974 - DNA, 25 bp, Artificial sequence
  SiRNA target sequence
tatccttccgttctcatttatttca

SEQ ID NO: 234975 - DNA, 25 bp, Artificial sequence
  SiRNA target sequence
atccttccgttctcatttatttcag

SEQ ID NO: 234976 - DNA, 25 bp, Artificial sequence
  SiRNA target sequence
tccttccgttctcatttatttcagt

SEQ ID NO: 234977 - DNA, 25 bp, Artificial sequence
  SiRNA target sequence
ccttccgttctcatttatttcagta

SEQ ID NO: 234978 - DNA, 25 bp, Artificial sequence
  SiRNA target sequence
cttccgttctcatttatttcagtag

SEQ ID NO: 234979 - DNA, 25 bp, Artificial sequence
  SiRNA target sequence
ttccgttctcatttatttcagtagg

SEQ ID NO: 234980 - DNA, 25 bp, Artificial sequence
  SiRNA target sequence
tccgttctcatttatttcagtaggt

SEQ ID NO: 234981 - DNA, 25 bp, Artificial sequence
  SiRNA target sequence
ccgttctcatttatttcagtaggta

SEQ ID NO: 234982 - DNA, 25 bp, Artificial sequence
  SiRNA target sequence
cgttctcatttatttcagtaggtat

SEQ ID NO: 234983 - DNA, 25 bp, Artificial sequence
  SiRNA target sequence
gttctcatttatttcagtaggtatt

SEQ ID NO: 234984 - DNA, 25 bp, Artificial sequence
  SiRNA target sequence
ttctcatttatttcagtaggtatta

SEQ ID NO: 234985 - DNA, 25 bp, Artificial sequence
  SiRNA target sequence
tctcatttatttcagtaggtattat

SEQ ID NO: 234986 - DNA, 25 bp, Artificial sequence
  SiRNA target sequence
ctcatttatttcagtaggtattatt

SEQ ID NO: 234987 - DNA, 25 bp, Artificial sequence
  SiRNA target sequence
tcatttatttcagtaggtattattc

SEQ ID NO: 234988 - DNA, 25 bp, Artificial sequence
  SiRNA target sequence
catttatttcagtaggtattattca

SEQ ID NO: 234989 - DNA, 25 bp, Artificial sequence
  SiRNA target sequence
atttatttcagtaggtattattcag

SEQ ID NO: 234990 - DNA, 25 bp, Artificial sequence
  SiRNA target sequence
tttatttcagtaggtattattcaga

SEQ ID NO: 234991 - DNA, 25 bp, Artificial sequence
  SiRNA target sequence
ttatttcagtaggtattattcagaa

SEQ ID NO: 234992 - DNA, 25 bp, Artificial sequence
  SiRNA target sequence
tatttcagtaggtattattcagaaa

SEQ ID NO: 234993 - DNA, 25 bp, Artificial sequence
  SiRNA target sequence
atttcagtaggtattattcagaaag

SEQ ID NO: 234994 - DNA, 25 bp, Artificial sequence
  SiRNA target sequence
tttcagtaggtattattcagaaagc

SEQ ID NO: 234995 - DNA, 25 bp, Artificial sequence
  SiRNA target sequence
ttcagtaggtattattcagaaagct

SEQ ID NO: 234996 - DNA, 25 bp, Artificial sequence
  SiRNA target sequence
tcagtaggtattattcagaaagctt

SEQ ID NO: 234997 - DNA, 25 bp, Artificial sequence
  SiRNA target sequence
cagtaggtattattcagaaagcttt

SEQ ID NO: 234998 - DNA, 25 bp, Artificial sequence
  SiRNA target sequence
agtaggtattattcagaaagcttta

SEQ ID NO: 234999 - DNA, 25 bp, Artificial sequence
  SiRNA target sequence
gtaggtattattcagaaagctttag

SEQ ID NO: 235000 - DNA, 25 bp, Artificial sequence
  SiRNA target sequence
taggtattattcagaaagctttaga

SEQ ID NO: 235001 - DNA, 25 bp, Artificial sequence
  SiRNA target sequence
aggtattattcagaaagctttagat

SEQ ID NO: 235002 - DNA, 25 bp, Artificial sequence
  SiRNA target sequence
ggtattattcagaaagctttagata

SEQ ID NO: 235003 - DNA, 25 bp, Artificial sequence
  SiRNA target sequence
gtattattcagaaagctttagataa

SEQ ID NO: 235004 - DNA, 25 bp, Artificial sequence
  SiRNA target sequence
tattattcagaaagctttagataaa

SEQ ID NO: 235005 - DNA, 25 bp, Artificial sequence
  SiRNA target sequence
attattcagaaagctttagataaat

SEQ ID NO: 235006 - DNA, 25 bp, Artificial sequence
  SiRNA target sequence
ttattcagaaagctttagataaata

SEQ ID NO: 235007 - DNA, 25 bp, Artificial sequence
  SiRNA target sequence
tattcagaaagctttagataaatat

SEQ ID NO: 235008 - DNA, 25 bp, Artificial sequence
  SiRNA target sequence
attcagaaagctttagataaatatc

SEQ ID NO: 235009 - DNA, 25 bp, Artificial sequence
  SiRNA target sequence
ttcagaaagctttagataaatatcc

SEQ ID NO: 235010 - DNA, 25 bp, Artificial sequence
  SiRNA target sequence
tcagaaagctttagataaatatcct

SEQ ID NO: 235011 - DNA, 25 bp, Artificial sequence
  SiRNA target sequence
cagaaagctttagataaatatcctt

SEQ ID NO: 235012 - DNA, 25 bp, Artificial sequence
  SiRNA target sequence
agaaagctttagataaatatccttt

SEQ ID NO: 235013 - DNA, 25 bp, Artificial sequence
  SiRNA target sequence
gaaagctttagataaatatcctttt

SEQ ID NO: 235014 - DNA, 25 bp, Artificial sequence
  SiRNA target sequence
aaagctttagataaatatcctttta

SEQ ID NO: 235015 - DNA, 25 bp, Artificial sequence
  SiRNA target sequence
aagctttagataaatatccttttac

SEQ ID NO: 235016 - DNA, 25 bp, Artificial sequence
  SiRNA target sequence
agctttagataaatatccttttaca

SEQ ID NO: 235017 - DNA, 25 bp, Artificial sequence
  SiRNA target sequence
gctttagataaatatccttttacaa

SEQ ID NO: 235018 - DNA, 25 bp, Artificial sequence
  SiRNA target sequence
ctttagataaatatccttttacaaa

SEQ ID NO: 235019 - DNA, 25 bp, Artificial sequence
  SiRNA target sequence
tttagataaatatccttttacaaaa

SEQ ID NO: 235020 - DNA, 25 bp, Artificial sequence
  SiRNA target sequence
ttagataaatatccttttacaaaaa

SEQ ID NO: 235021 - DNA, 25 bp, Artificial sequence
  SiRNA target sequence
tagataaatatccttttacaaaaat

SEQ ID NO: 235022 - DNA, 25 bp, Artificial sequence
  SiRNA target sequence
agataaatatccttttacaaaaata

SEQ ID NO: 235023 - DNA, 25 bp, Artificial sequence
  SiRNA target sequence
gataaatatccttttacaaaaatat

SEQ ID NO: 235024 - DNA, 25 bp, Artificial sequence
  SiRNA target sequence
ataaatatccttttacaaaaatatt

SEQ ID NO: 235025 - DNA, 25 bp, Artificial sequence
  SiRNA target sequence
taaatatccttttacaaaaatattt

SEQ ID NO: 235026 - DNA, 25 bp, Artificial sequence
  SiRNA target sequence
aaatatccttttacaaaaatatttg

SEQ ID NO: 235027 - DNA, 25 bp, Artificial sequence
  SiRNA target sequence
aatatccttttacaaaaatatttga

SEQ ID NO: 235028 - DNA, 25 bp, Artificial sequence
  SiRNA target sequence
atatccttttacaaaaatatttgat

SEQ ID NO: 235029 - DNA, 25 bp, Artificial sequence
  SiRNA target sequence
tatccttttacaaaaatatttgatg

SEQ ID NO: 235030 - DNA, 25 bp, Artificial sequence
  SiRNA target sequence
atccttttacaaaaatatttgatgt

SEQ ID NO: 235031 - DNA, 25 bp, Artificial sequence
  SiRNA target sequence
tccttttacaaaaatatttgatgta

SEQ ID NO: 235032 - DNA, 25 bp, Artificial sequence
  SiRNA target sequence
ccttttacaaaaatatttgatgtaa

SEQ ID NO: 235033 - DNA, 25 bp, Artificial sequence
  SiRNA target sequence
cttttacaaaaatatttgatgtaac

SEQ ID NO: 235034 - DNA, 25 bp, Artificial sequence
  SiRNA target sequence
ttttacaaaaatatttgatgtaact

SEQ ID NO: 235035 - DNA, 25 bp, Artificial sequence
  SiRNA target sequence
tttacaaaaatatttgatgtaactt

SEQ ID NO: 235036 - DNA, 25 bp, Artificial sequence
  SiRNA target sequence
ttacaaaaatatttgatgtaacttt

SEQ ID NO: 235037 - DNA, 25 bp, Artificial sequence
  SiRNA target sequence
tacaaaaatatttgatgtaacttta

SEQ ID NO: 235038 - DNA, 25 bp, Artificial sequence
  SiRNA target sequence
acaaaaatatttgatgtaactttaa

SEQ ID NO: 235039 - DNA, 25 bp, Artificial sequence
  SiRNA target sequence
caaaaatatttgatgtaactttaat

SEQ ID NO: 235040 - DNA, 25 bp, Artificial sequence
  SiRNA target sequence
aaaaatatttgatgtaactttaata

SEQ ID NO: 235041 - DNA, 25 bp, Artificial sequence
  SiRNA target sequence
aaaatatttgatgtaactttaatag

SEQ ID NO: 235042 - DNA, 25 bp, Artificial sequence
  SiRNA target sequence
aaatatttgatgtaactttaatagt

SEQ ID NO: 235043 - DNA, 25 bp, Artificial sequence
  SiRNA target sequence
aatatttgatgtaactttaatagtt

SEQ ID NO: 235044 - DNA, 25 bp, Artificial sequence
  SiRNA target sequence
atatttgatgtaactttaatagttt

SEQ ID NO: 235045 - DNA, 25 bp, Artificial sequence
  SiRNA target sequence
tatttgatgtaactttaatagtttt

SEQ ID NO: 235046 - DNA, 25 bp, Artificial sequence
  SiRNA target sequence
atttgatgtaactttaatagttttc

SEQ ID NO: 235047 - DNA, 25 bp, Artificial sequence
  SiRNA target sequence
tttgatgtaactttaatagttttcg

SEQ ID NO: 235048 - DNA, 25 bp, Artificial sequence
  SiRNA target sequence
ttgatgtaactttaatagttttcgc

SEQ ID NO: 235049 - DNA, 25 bp, Artificial sequence
  SiRNA target sequence
tgatgtaactttaatagttttcgct

SEQ ID NO: 235050 - DNA, 25 bp, Artificial sequence
  SiRNA target sequence
gatgtaactttaatagttttcgctg

SEQ ID NO: 235051 - DNA, 25 bp, Artificial sequence
  SiRNA target sequence
atgtaactttaatagttttcgctgt

SEQ ID NO: 235052 - DNA, 25 bp, Artificial sequence
  SiRNA target sequence
tgtaactttaatagttttcgctgtt

SEQ ID NO: 235053 - DNA, 25 bp, Artificial sequence
  SiRNA target sequence
gtaactttaatagttttcgctgttg

SEQ ID NO: 235054 - DNA, 25 bp, Artificial sequence
  SiRNA target sequence
taactttaatagttttcgctgttgc

SEQ ID NO: 235055 - DNA, 25 bp, Artificial sequence
  SiRNA target sequence
aactttaatagttttcgctgttgca

SEQ ID NO: 235056 - DNA, 25 bp, Artificial sequence
  SiRNA target sequence
actttaatagttttcgctgttgcat

SEQ ID NO: 235057 - DNA, 25 bp, Artificial sequence
  SiRNA target sequence
ctttaatagttttcgctgttgcatt

SEQ ID NO: 235058 - DNA, 25 bp, Artificial sequence
  SiRNA target sequence
tttaatagttttcgctgttgcattt

SEQ ID NO: 235059 - DNA, 25 bp, Artificial sequence
  SiRNA target sequence
ttaatagttttcgctgttgcattta

SEQ ID NO: 235060 - DNA, 25 bp, Artificial sequence
  SiRNA target sequence
taatagttttcgctgttgcatttac

SEQ ID NO: 235061 - DNA, 25 bp, Artificial sequence
  SiRNA target sequence
aatagttttcgctgttgcatttact

SEQ ID NO: 235062 - DNA, 25 bp, Artificial sequence
  SiRNA target sequence
atagttttcgctgttgcatttacta

SEQ ID NO: 235063 - DNA, 25 bp, Artificial sequence
  SiRNA target sequence
tagttttcgctgttgcatttactat

SEQ ID NO: 235064 - DNA, 25 bp, Artificial sequence
  SiRNA target sequence
agttttcgctgttgcatttactata

SEQ ID NO: 235065 - DNA, 25 bp, Artificial sequence
  SiRNA target sequence
gttttcgctgttgcatttactatac

SEQ ID NO: 235066 - DNA, 25 bp, Artificial sequence
  SiRNA target sequence
ttttcgctgttgcatttactatact

SEQ ID NO: 235067 - DNA, 25 bp, Artificial sequence
  SiRNA target sequence
tttcgctgttgcatttactatactt

SEQ ID NO: 235068 - DNA, 25 bp, Artificial sequence
  SiRNA target sequence
ttcgctgttgcatttactatacttg

SEQ ID NO: 235069 - DNA, 25 bp, Artificial sequence
  SiRNA target sequence
tcgctgttgcatttactatacttgg

SEQ ID NO: 235070 - DNA, 25 bp, Artificial sequence
  SiRNA target sequence
cgctgttgcatttactatacttggt

SEQ ID NO: 235071 - DNA, 25 bp, Artificial sequence
  SiRNA target sequence
gctgttgcatttactatacttggta

SEQ ID NO: 235072 - DNA, 25 bp, Artificial sequence
  SiRNA target sequence
ctgttgcatttactatacttggtag

SEQ ID NO: 235073 - DNA, 25 bp, Artificial sequence
  SiRNA target sequence
tgttgcatttactatacttggtagt

SEQ ID NO: 235074 - DNA, 25 bp, Artificial sequence
  SiRNA target sequence
gttgcatttactatacttggtagtt

SEQ ID NO: 235075 - DNA, 25 bp, Artificial sequence
  SiRNA target sequence
ttgcatttactatacttggtagttt

SEQ ID NO: 235076 - DNA, 25 bp, Artificial sequence
  SiRNA target sequence
tgcatttactatacttggtagttta

SEQ ID NO: 235077 - DNA, 25 bp, Artificial sequence
  SiRNA target sequence
gcatttactatacttggtagtttat

SEQ ID NO: 235078 - DNA, 25 bp, Artificial sequence
  SiRNA target sequence
catttactatacttggtagtttatt

SEQ ID NO: 235079 - DNA, 25 bp, Artificial sequence
  SiRNA target sequence
atttactatacttggtagtttatta

SEQ ID NO: 235080 - DNA, 25 bp, Artificial sequence
  SiRNA target sequence
tttactatacttggtagtttattac

SEQ ID NO: 235081 - DNA, 25 bp, Artificial sequence
  SiRNA target sequence
ttactatacttggtagtttattact

SEQ ID NO: 235082 - DNA, 25 bp, Artificial sequence
  SiRNA target sequence
tactatacttggtagtttattactt

SEQ ID NO: 235083 - DNA, 25 bp, Artificial sequence
  SiRNA target sequence
actatacttggtagtttattacttc

SEQ ID NO: 235084 - DNA, 25 bp, Artificial sequence
  SiRNA target sequence
ctatacttggtagtttattacttcc

SEQ ID NO: 235085 - DNA, 25 bp, Artificial sequence
  SiRNA target sequence
tatacttggtagtttattacttccc

SEQ ID NO: 235086 - DNA, 25 bp, Artificial sequence
  SiRNA target sequence
atacttggtagtttattacttccct

SEQ ID NO: 235087 - DNA, 25 bp, Artificial sequence
  SiRNA target sequence
tacttggtagtttattacttccctt

SEQ ID NO: 235088 - DNA, 25 bp, Artificial sequence
  SiRNA target sequence
acttggtagtttattacttcccttt

SEQ ID NO: 235089 - DNA, 25 bp, Artificial sequence
  SiRNA target sequence
cttggtagtttattacttcccttta

SEQ ID NO: 235090 - DNA, 25 bp, Artificial sequence
  SiRNA target sequence
ttggtagtttattacttccctttag

SEQ ID NO: 235091 - DNA, 25 bp, Artificial sequence
  SiRNA target sequence
tggtagtttattacttccctttagt

SEQ ID NO: 235092 - DNA, 25 bp, Artificial sequence
  SiRNA target sequence
ggtagtttattacttccctttagtg

SEQ ID NO: 235093 - DNA, 25 bp, Artificial sequence
  SiRNA target sequence
gtagtttattacttccctttagtga

SEQ ID NO: 235094 - DNA, 25 bp, Artificial sequence
  SiRNA target sequence
tagtttattacttccctttagtgat

SEQ ID NO: 235095 - DNA, 25 bp, Artificial sequence
  SiRNA target sequence
agtttattacttccctttagtgatt

SEQ ID NO: 235096 - DNA, 25 bp, Artificial sequence
  SiRNA target sequence
gtttattacttccctttagtgatta

SEQ ID NO: 235097 - DNA, 25 bp, Artificial sequence
  SiRNA target sequence
tttattacttccctttagtgattat

SEQ ID NO: 235098 - DNA, 25 bp, Artificial sequence
  SiRNA target sequence
ttattacttccctttagtgattata

SEQ ID NO: 235099 - DNA, 25 bp, Artificial sequence
  SiRNA target sequence
tattacttccctttagtgattatat

SEQ ID NO: 235100 - DNA, 25 bp, Artificial sequence
  SiRNA target sequence
attacttccctttagtgattatatt

SEQ ID NO: 235101 - DNA, 25 bp, Artificial sequence
  SiRNA target sequence
ttacttccctttagtgattatattc

SEQ ID NO: 235102 - DNA, 25 bp, Artificial sequence
  SiRNA target sequence
tacttccctttagtgattatattca

SEQ ID NO: 235103 - DNA, 25 bp, Artificial sequence
  SiRNA target sequence
acttccctttagtgattatattcag

SEQ ID NO: 235104 - DNA, 25 bp, Artificial sequence
  SiRNA target sequence
cttccctttagtgattatattcaga

SEQ ID NO: 235105 - DNA, 25 bp, Artificial sequence
  SiRNA target sequence
ttccctttagtgattatattcagat

SEQ ID NO: 235106 - DNA, 25 bp, Artificial sequence
  SiRNA target sequence
tccctttagtgattatattcagatt

SEQ ID NO: 235107 - DNA, 25 bp, Artificial sequence
  SiRNA target sequence
ccctttagtgattatattcagattc

SEQ ID NO: 235108 - DNA, 25 bp, Artificial sequence
  SiRNA target sequence
cctttagtgattatattcagattca

SEQ ID NO: 235109 - DNA, 25 bp, Artificial sequence
  SiRNA target sequence
ctttagtgattatattcagattcaa

SEQ ID NO: 235110 - DNA, 25 bp, Artificial sequence
  SiRNA target sequence
tttagtgattatattcagattcaac

SEQ ID NO: 235111 - DNA, 25 bp, Artificial sequence
  SiRNA target sequence
ttagtgattatattcagattcaacc

SEQ ID NO: 235112 - DNA, 25 bp, Artificial sequence
  SiRNA target sequence
tagtgattatattcagattcaaccg

SEQ ID NO: 235113 - DNA, 25 bp, Artificial sequence
  SiRNA target sequence
agtgattatattcagattcaaccgt

SEQ ID NO: 235114 - DNA, 25 bp, Artificial sequence
  SiRNA target sequence
gtgattatattcagattcaaccgtt

SEQ ID NO: 235115 - DNA, 25 bp, Artificial sequence
  SiRNA target sequence
tgattatattcagattcaaccgttt

SEQ ID NO: 235116 - DNA, 25 bp, Artificial sequence
  SiRNA target sequence
gattatattcagattcaaccgtttt

SEQ ID NO: 235117 - DNA, 25 bp, Artificial sequence
  SiRNA target sequence
attatattcagattcaaccgttttg

SEQ ID NO: 235118 - DNA, 25 bp, Artificial sequence
  SiRNA target sequence
ttatattcagattcaaccgttttgg

SEQ ID NO: 235119 - DNA, 25 bp, Artificial sequence
  SiRNA target sequence
tatattcagattcaaccgttttggg

SEQ ID NO: 235120 - DNA, 25 bp, Artificial sequence
  SiRNA target sequence
atattcagattcaaccgttttgggc

SEQ ID NO: 235121 - DNA, 25 bp, Artificial sequence
  SiRNA target sequence
tattcagattcaaccgttttgggcc

SEQ ID NO: 235122 - DNA, 25 bp, Artificial sequence
  SiRNA target sequence
attcagattcaaccgttttgggcca

SEQ ID NO: 235123 - DNA, 25 bp, Artificial sequence
  SiRNA target sequence
ttcagattcaaccgttttgggccaa

SEQ ID NO: 235124 - DNA, 25 bp, Artificial sequence
  SiRNA target sequence
tcagattcaaccgttttgggccaaa

SEQ ID NO: 235125 - DNA, 25 bp, Artificial sequence
  SiRNA target sequence
cagattcaaccgttttgggccaaag

SEQ ID NO: 235126 - DNA, 25 bp, Artificial sequence
  SiRNA target sequence
agattcaaccgttttgggccaaaga

SEQ ID NO: 235127 - DNA, 25 bp, Artificial sequence
  SiRNA target sequence
gattcaaccgttttgggccaaagat

SEQ ID NO: 235128 - DNA, 25 bp, Artificial sequence
  SiRNA target sequence
attcaaccgttttgggccaaagata

SEQ ID NO: 235129 - DNA, 25 bp, Artificial sequence
  SiRNA target sequence
ttcaaccgttttgggccaaagatat

SEQ ID NO: 235130 - DNA, 25 bp, Artificial sequence
  SiRNA target sequence
tcaaccgttttgggccaaagatatt

SEQ ID NO: 235131 - DNA, 25 bp, Artificial sequence
  SiRNA target sequence
caaccgttttgggccaaagatattt

SEQ ID NO: 235132 - DNA, 25 bp, Artificial sequence
  SiRNA target sequence
aaccgttttgggccaaagatatttt

SEQ ID NO: 235133 - DNA, 25 bp, Artificial sequence
  SiRNA target sequence
accgttttgggccaaagatattttt

SEQ ID NO: 235134 - DNA, 25 bp, Artificial sequence
  SiRNA target sequence
ccgttttgggccaaagatatttttg

SEQ ID NO: 235135 - DNA, 25 bp, Artificial sequence
  SiRNA target sequence
cgttttgggccaaagatatttttgc

SEQ ID NO: 235136 - DNA, 25 bp, Artificial sequence
  SiRNA target sequence
gttttgggccaaagatatttttgct

SEQ ID NO: 235137 - DNA, 25 bp, Artificial sequence
  SiRNA target sequence
ttttgggccaaagatatttttgctg

SEQ ID NO: 235138 - DNA, 25 bp, Artificial sequence
  SiRNA target sequence
tttgggccaaagatatttttgctga

SEQ ID NO: 235139 - DNA, 25 bp, Artificial sequence
  SiRNA target sequence
ttgggccaaagatatttttgctgat

SEQ ID NO: 235140 - DNA, 25 bp, Artificial sequence
  SiRNA target sequence
tgggccaaagatatttttgctgatg

SEQ ID NO: 235141 - DNA, 25 bp, Artificial sequence
  SiRNA target sequence
gggccaaagatatttttgctgatgg

SEQ ID NO: 235142 - DNA, 25 bp, Artificial sequence
  SiRNA target sequence
ggccaaagatatttttgctgatgga

SEQ ID NO: 235143 - DNA, 25 bp, Artificial sequence
  SiRNA target sequence
gccaaagatatttttgctgatggaa

SEQ ID NO: 235144 - DNA, 25 bp, Artificial sequence
  SiRNA target sequence
ccaaagatatttttgctgatggaaa

SEQ ID NO: 235145 - DNA, 25 bp, Artificial sequence
  SiRNA target sequence
caaagatatttttgctgatggaaaa

SEQ ID NO: 235146 - DNA, 25 bp, Artificial sequence
  SiRNA target sequence
aaagatatttttgctgatggaaaag

SEQ ID NO: 235147 - DNA, 25 bp, Artificial sequence
  SiRNA target sequence
aagatatttttgctgatggaaaagc

SEQ ID NO: 235148 - DNA, 25 bp, Artificial sequence
  SiRNA target sequence
agatatttttgctgatggaaaagct

SEQ ID NO: 235149 - DNA, 25 bp, Artificial sequence
  SiRNA target sequence
gatatttttgctgatggaaaagctg

SEQ ID NO: 235150 - DNA, 25 bp, Artificial sequence
  SiRNA target sequence
atatttttgctgatggaaaagctgt

SEQ ID NO: 235151 - DNA, 25 bp, Artificial sequence
  SiRNA target sequence
tatttttgctgatggaaaagctgtt

SEQ ID NO: 235152 - DNA, 25 bp, Artificial sequence
  SiRNA target sequence
atttttgctgatggaaaagctgttg

SEQ ID NO: 235153 - DNA, 25 bp, Artificial sequence
  SiRNA target sequence
tttttgctgatggaaaagctgttgc

SEQ ID NO: 235154 - DNA, 25 bp, Artificial sequence
  SiRNA target sequence
ttttgctgatggaaaagctgttgcc

SEQ ID NO: 235155 - DNA, 25 bp, Artificial sequence
  SiRNA target sequence
tttgctgatggaaaagctgttgcca

SEQ ID NO: 235156 - DNA, 25 bp, Artificial sequence
  SiRNA target sequence
ttgctgatggaaaagctgttgccag

SEQ ID NO: 235157 - DNA, 25 bp, Artificial sequence
  SiRNA target sequence
tgctgatggaaaagctgttgccaga

SEQ ID NO: 235158 - DNA, 25 bp, Artificial sequence
  SiRNA target sequence
gctgatggaaaagctgttgccagaa

SEQ ID NO: 235159 - DNA, 25 bp, Artificial sequence
  SiRNA target sequence
ctgatggaaaagctgttgccagaag

SEQ ID NO: 235160 - DNA, 25 bp, Artificial sequence
  SiRNA target sequence
tgatggaaaagctgttgccagaagt

SEQ ID NO: 235161 - DNA, 25 bp, Artificial sequence
  SiRNA target sequence
gatggaaaagctgttgccagaagta

SEQ ID NO: 235162 - DNA, 25 bp, Artificial sequence
  SiRNA target sequence
atggaaaagctgttgccagaagtac

SEQ ID NO: 235163 - DNA, 25 bp, Artificial sequence
  SiRNA target sequence
tggaaaagctgttgccagaagtaca

SEQ ID NO: 235164 - DNA, 25 bp, Artificial sequence
  SiRNA target sequence
ggaaaagctgttgccagaagtacag

SEQ ID NO: 235165 - DNA, 25 bp, Artificial sequence
  SiRNA target sequence
gaaaagctgttgccagaagtacaga

SEQ ID NO: 235166 - DNA, 25 bp, Artificial sequence
  SiRNA target sequence
aaaagctgttgccagaagtacagat

SEQ ID NO: 235167 - DNA, 25 bp, Artificial sequence
  SiRNA target sequence
aaagctgttgccagaagtacagatt

SEQ ID NO: 235168 - DNA, 25 bp, Artificial sequence
  SiRNA target sequence
aagctgttgccagaagtacagattt

SEQ ID NO: 235169 - DNA, 25 bp, Artificial sequence
  SiRNA target sequence
agctgttgccagaagtacagatttt

SEQ ID NO: 235170 - DNA, 25 bp, Artificial sequence
  SiRNA target sequence
gctgttgccagaagtacagattttt

SEQ ID NO: 235171 - DNA, 25 bp, Artificial sequence
  SiRNA target sequence
ctgttgccagaagtacagatttttt

SEQ ID NO: 235172 - DNA, 25 bp, Artificial sequence
  SiRNA target sequence
tgttgccagaagtacagatttttta

SEQ ID NO: 235173 - DNA, 25 bp, Artificial sequence
  SiRNA target sequence
gttgccagaagtacagattttttat

SEQ ID NO: 235174 - DNA, 25 bp, Artificial sequence
  SiRNA target sequence
ttgccagaagtacagattttttatt

SEQ ID NO: 235175 - DNA, 25 bp, Artificial sequence
  SiRNA target sequence
tgccagaagtacagattttttattt

SEQ ID NO: 235176 - DNA, 25 bp, Artificial sequence
  SiRNA target sequence
gccagaagtacagattttttatttt

SEQ ID NO: 235177 - DNA, 25 bp, Artificial sequence
  SiRNA target sequence
ccagaagtacagattttttattttc

SEQ ID NO: 235178 - DNA, 25 bp, Artificial sequence
  SiRNA target sequence
cagaagtacagattttttattttct

SEQ ID NO: 235179 - DNA, 25 bp, Artificial sequence
  SiRNA target sequence
agaagtacagattttttattttcta

SEQ ID NO: 235180 - DNA, 25 bp, Artificial sequence
  SiRNA target sequence
gaagtacagattttttattttctat

SEQ ID NO: 235181 - DNA, 25 bp, Artificial sequence
  SiRNA target sequence
aagtacagattttttattttctatt

SEQ ID NO: 235182 - DNA, 25 bp, Artificial sequence
  SiRNA target sequence
agtacagattttttattttctattg

SEQ ID NO: 235183 - DNA, 25 bp, Artificial sequence
  SiRNA target sequence
gtacagattttttattttctattgc

SEQ ID NO: 235184 - DNA, 25 bp, Artificial sequence
  SiRNA target sequence
tacagattttttattttctattgca

SEQ ID NO: 235185 - DNA, 25 bp, Artificial sequence
  SiRNA target sequence
acagattttttattttctattgcac

SEQ ID NO: 235186 - DNA, 25 bp, Artificial sequence
  SiRNA target sequence
cagattttttattttctattgcact

SEQ ID NO: 235187 - DNA, 25 bp, Artificial sequence
  SiRNA target sequence
agattttttattttctattgcactt

SEQ ID NO: 235188 - DNA, 25 bp, Artificial sequence
  SiRNA target sequence
gattttttattttctattgcacttg

SEQ ID NO: 235189 - DNA, 25 bp, Artificial sequence
  SiRNA target sequence
attttttattttctattgcacttgt

SEQ ID NO: 235190 - DNA, 25 bp, Artificial sequence
  SiRNA target sequence
ttttttattttctattgcacttgtt

SEQ ID NO: 235191 - DNA, 25 bp, Artificial sequence
  SiRNA target sequence
tttttattttctattgcacttgttt

SEQ ID NO: 235192 - DNA, 25 bp, Artificial sequence
  SiRNA target sequence
ttttattttctattgcacttgtttt

SEQ ID NO: 235193 - DNA, 25 bp, Artificial sequence
  SiRNA target sequence
tttattttctattgcacttgttttc

SEQ ID NO: 235194 - DNA, 25 bp, Artificial sequence
  SiRNA target sequence
ttattttctattgcacttgttttca

SEQ ID NO: 235195 - DNA, 25 bp, Artificial sequence
  SiRNA target sequence
tattttctattgcacttgttttcaa

SEQ ID NO: 235196 - DNA, 25 bp, Artificial sequence
  SiRNA target sequence
attttctattgcacttgttttcaat

SEQ ID NO: 235197 - DNA, 25 bp, Artificial sequence
  SiRNA target sequence
ttttctattgcacttgttttcaatg

SEQ ID NO: 235198 - DNA, 25 bp, Artificial sequence
  SiRNA target sequence
tttctattgcacttgttttcaatga

SEQ ID NO: 235199 - DNA, 25 bp, Artificial sequence
  SiRNA target sequence
ttctattgcacttgttttcaatgaa

SEQ ID NO: 235200 - DNA, 25 bp, Artificial sequence
  SiRNA target sequence
tctattgcacttgttttcaatgaat

SEQ ID NO: 235201 - DNA, 25 bp, Artificial sequence
  SiRNA target sequence
ctattgcacttgttttcaatgaatg

SEQ ID NO: 235202 - DNA, 25 bp, Artificial sequence
  SiRNA target sequence
tattgcacttgttttcaatgaatgg

SEQ ID NO: 235203 - DNA, 25 bp, Artificial sequence
  SiRNA target sequence
attgcacttgttttcaatgaatgga

SEQ ID NO: 235204 - DNA, 25 bp, Artificial sequence
  SiRNA target sequence
ttgcacttgttttcaatgaatggac

SEQ ID NO: 235205 - DNA, 25 bp, Artificial sequence
  SiRNA target sequence
tgcacttgttttcaatgaatggaca

SEQ ID NO: 235206 - DNA, 25 bp, Artificial sequence
  SiRNA target sequence
gcacttgttttcaatgaatggacaa

SEQ ID NO: 235207 - DNA, 25 bp, Artificial sequence
  SiRNA target sequence
cacttgttttcaatgaatggacaag

SEQ ID NO: 235208 - DNA, 25 bp, Artificial sequence
  SiRNA target sequence
acttgttttcaatgaatggacaagt

SEQ ID NO: 235209 - DNA, 25 bp, Artificial sequence
  SiRNA target sequence
cttgttttcaatgaatggacaagtt

SEQ ID NO: 235210 - DNA, 25 bp, Artificial sequence
  SiRNA target sequence
ttgttttcaatgaatggacaagttc

SEQ ID NO: 235211 - DNA, 25 bp, Artificial sequence
  SiRNA target sequence
tgttttcaatgaatggacaagttct

SEQ ID NO: 235212 - DNA, 25 bp, Artificial sequence
  SiRNA target sequence
gttttcaatgaatggacaagttctg

SEQ ID NO: 235213 - DNA, 25 bp, Artificial sequence
  SiRNA target sequence
ttttcaatgaatggacaagttctgc

SEQ ID NO: 235214 - DNA, 25 bp, Artificial sequence
  SiRNA target sequence
tttcaatgaatggacaagttctgct

SEQ ID NO: 235215 - DNA, 25 bp, Artificial sequence
  SiRNA target sequence
ttcaatgaatggacaagttctgcta

SEQ ID NO: 235216 - DNA, 25 bp, Artificial sequence
  SiRNA target sequence
tcaatgaatggacaagttctgctat

SEQ ID NO: 235217 - DNA, 25 bp, Artificial sequence
  SiRNA target sequence
caatgaatggacaagttctgctatc

SEQ ID NO: 235218 - DNA, 25 bp, Artificial sequence
  SiRNA target sequence
aatgaatggacaagttctgctatct

SEQ ID NO: 235219 - DNA, 25 bp, Artificial sequence
  SiRNA target sequence
atgaatggacaagttctgctatcta

SEQ ID NO: 235220 - DNA, 25 bp, Artificial sequence
  SiRNA target sequence
tgaatggacaagttctgctatctat

SEQ ID NO: 235221 - DNA, 25 bp, Artificial sequence
  SiRNA target sequence
gaatggacaagttctgctatctatg

SEQ ID NO: 235222 - DNA, 25 bp, Artificial sequence
  SiRNA target sequence
aatggacaagttctgctatctatgt

SEQ ID NO: 235223 - DNA, 25 bp, Artificial sequence
  SiRNA target sequence
atggacaagttctgctatctatgtt

SEQ ID NO: 235224 - DNA, 25 bp, Artificial sequence
  SiRNA target sequence
tggacaagttctgctatctatgttt

SEQ ID NO: 235225 - DNA, 25 bp, Artificial sequence
  SiRNA target sequence
ggacaagttctgctatctatgtttt

SEQ ID NO: 235226 - DNA, 25 bp, Artificial sequence
  SiRNA target sequence
gacaagttctgctatctatgtttta

SEQ ID NO: 235227 - DNA, 25 bp, Artificial sequence
  SiRNA target sequence
acaagttctgctatctatgttttat

SEQ ID NO: 235228 - DNA, 25 bp, Artificial sequence
  SiRNA target sequence
caagttctgctatctatgttttatc

SEQ ID NO: 235229 - DNA, 25 bp, Artificial sequence
  SiRNA target sequence
aagttctgctatctatgttttatct

SEQ ID NO: 235230 - DNA, 25 bp, Artificial sequence
  SiRNA target sequence
agttctgctatctatgttttatctg

SEQ ID NO: 235231 - DNA, 25 bp, Artificial sequence
  SiRNA target sequence
gttctgctatctatgttttatctga

SEQ ID NO: 235232 - DNA, 25 bp, Artificial sequence
  SiRNA target sequence
ttctgctatctatgttttatctgaa

SEQ ID NO: 235233 - DNA, 25 bp, Artificial sequence
  SiRNA target sequence
tctgctatctatgttttatctgaaa

SEQ ID NO: 235234 - DNA, 25 bp, Artificial sequence
  SiRNA target sequence
ctgctatctatgttttatctgaaat

SEQ ID NO: 235235 - DNA, 25 bp, Artificial sequence
  SiRNA target sequence
tgctatctatgttttatctgaaatg

SEQ ID NO: 235236 - DNA, 25 bp, Artificial sequence
  SiRNA target sequence
gctatctatgttttatctgaaatgt

SEQ ID NO: 235237 - DNA, 25 bp, Artificial sequence
  SiRNA target sequence
ctatctatgttttatctgaaatgtt

SEQ ID NO: 235238 - DNA, 25 bp, Artificial sequence
  SiRNA target sequence
tatctatgttttatctgaaatgttt

SEQ ID NO: 235239 - DNA, 25 bp, Artificial sequence
  SiRNA target sequence
atctatgttttatctgaaatgtttg

SEQ ID NO: 235240 - DNA, 25 bp, Artificial sequence
  SiRNA target sequence
tctatgttttatctgaaatgtttgg

SEQ ID NO: 235241 - DNA, 25 bp, Artificial sequence
  SiRNA target sequence
ctatgttttatctgaaatgtttggt

SEQ ID NO: 235242 - DNA, 25 bp, Artificial sequence
  SiRNA target sequence
tatgttttatctgaaatgtttggta

SEQ ID NO: 235243 - DNA, 25 bp, Artificial sequence
  SiRNA target sequence
atgttttatctgaaatgtttggtag

SEQ ID NO: 235244 - DNA, 25 bp, Artificial sequence
  SiRNA target sequence
tgttttatctgaaatgtttggtagt

SEQ ID NO: 235245 - DNA, 25 bp, Artificial sequence
  SiRNA target sequence
gttttatctgaaatgtttggtagtt

SEQ ID NO: 235246 - DNA, 25 bp, Artificial sequence
  SiRNA target sequence
ttttatctgaaatgtttggtagttt

SEQ ID NO: 235247 - DNA, 25 bp, Artificial sequence
  SiRNA target sequence
tttatctgaaatgtttggtagtttg

SEQ ID NO: 235248 - DNA, 25 bp, Artificial sequence
  SiRNA target sequence
ttatctgaaatgtttggtagtttga

SEQ ID NO: 235249 - DNA, 25 bp, Artificial sequence
  SiRNA target sequence
tatctgaaatgtttggtagtttgat

SEQ ID NO: 235250 - DNA, 25 bp, Artificial sequence
  SiRNA target sequence
atctgaaatgtttggtagtttgatt

SEQ ID NO: 235251 - DNA, 25 bp, Artificial sequence
  SiRNA target sequence
tctgaaatgtttggtagtttgattc

SEQ ID NO: 235252 - DNA, 25 bp, Artificial sequence
  SiRNA target sequence
ctgaaatgtttggtagtttgattct

SEQ ID NO: 235253 - DNA, 25 bp, Artificial sequence
  SiRNA target sequence
tgaaatgtttggtagtttgattctt

SEQ ID NO: 235254 - DNA, 25 bp, Artificial sequence
  SiRNA target sequence
gaaatgtttggtagtttgattcttt

SEQ ID NO: 235255 - DNA, 25 bp, Artificial sequence
  SiRNA target sequence
aaatgtttggtagtttgattctttc

SEQ ID NO: 235256 - DNA, 25 bp, Artificial sequence
  SiRNA target sequence
aatgtttggtagtttgattctttca

SEQ ID NO: 235257 - DNA, 25 bp, Artificial sequence
  SiRNA target sequence
atgtttggtagtttgattctttcat

SEQ ID NO: 235258 - DNA, 25 bp, Artificial sequence
  SiRNA target sequence
tgtttggtagtttgattctttcata

SEQ ID NO: 235259 - DNA, 25 bp, Artificial sequence
  SiRNA target sequence
gtttggtagtttgattctttcatat

SEQ ID NO: 235260 - DNA, 25 bp, Artificial sequence
  SiRNA target sequence
tttggtagtttgattctttcatatt

SEQ ID NO: 235261 - DNA, 25 bp, Artificial sequence
  SiRNA target sequence
ttggtagtttgattctttcatattt

SEQ ID NO: 235262 - DNA, 25 bp, Artificial sequence
  SiRNA target sequence
tggtagtttgattctttcatattta

SEQ ID NO: 235263 - DNA, 25 bp, Artificial sequence
  SiRNA target sequence
ggtagtttgattctttcatatttat

SEQ ID NO: 235264 - DNA, 25 bp, Artificial sequence
  SiRNA target sequence
gtagtttgattctttcatatttatt

SEQ ID NO: 235265 - DNA, 25 bp, Artificial sequence
  SiRNA target sequence
tagtttgattctttcatatttattt

SEQ ID NO: 235266 - DNA, 25 bp, Artificial sequence
  SiRNA target sequence
agtttgattctttcatatttattta

SEQ ID NO: 235267 - DNA, 25 bp, Artificial sequence
  SiRNA target sequence
gtttgattctttcatatttatttat

SEQ ID NO: 235268 - DNA, 25 bp, Artificial sequence
  SiRNA target sequence
tttgattctttcatatttatttatg

SEQ ID NO: 235269 - DNA, 25 bp, Artificial sequence
  SiRNA target sequence
ttgattctttcatatttatttatga

SEQ ID NO: 235270 - DNA, 25 bp, Artificial sequence
  SiRNA target sequence
tgattctttcatatttatttatgac

SEQ ID NO: 235271 - DNA, 25 bp, Artificial sequence
  SiRNA target sequence
gattctttcatatttatttatgacg

SEQ ID NO: 235272 - DNA, 25 bp, Artificial sequence
  SiRNA target sequence
attctttcatatttatttatgacgt

SEQ ID NO: 235273 - DNA, 25 bp, Artificial sequence
  SiRNA target sequence
ttctttcatatttatttatgacgtt

SEQ ID NO: 235274 - DNA, 25 bp, Artificial sequence
  SiRNA target sequence
tctttcatatttatttatgacgttt

SEQ ID NO: 235275 - DNA, 25 bp, Artificial sequence
  SiRNA target sequence
ctttcatatttatttatgacgtttg

SEQ ID NO: 235276 - DNA, 25 bp, Artificial sequence
  SiRNA target sequence
tttcatatttatttatgacgtttgc

SEQ ID NO: 235277 - DNA, 25 bp, Artificial sequence
  SiRNA target sequence
ttcatatttatttatgacgtttgct

SEQ ID NO: 235278 - DNA, 25 bp, Artificial sequence
  SiRNA target sequence
tcatatttatttatgacgtttgcta

SEQ ID NO: 235279 - DNA, 25 bp, Artificial sequence
  SiRNA target sequence
catatttatttatgacgtttgctaa

SEQ ID NO: 235280 - DNA, 25 bp, Artificial sequence
  SiRNA target sequence
atatttatttatgacgtttgctaat

SEQ ID NO: 235281 - DNA, 25 bp, Artificial sequence
  SiRNA target sequence
tatttatttatgacgtttgctaatg

SEQ ID NO: 235282 - DNA, 25 bp, Artificial sequence
  SiRNA target sequence
atttatttatgacgtttgctaatgg

SEQ ID NO: 235283 - DNA, 25 bp, Artificial sequence
  SiRNA target sequence
tttatttatgacgtttgctaatggt

SEQ ID NO: 235284 - DNA, 25 bp, Artificial sequence
  SiRNA target sequence
ttatttatgacgtttgctaatggtc

SEQ ID NO: 235285 - DNA, 25 bp, Artificial sequence
  SiRNA target sequence
tatttatgacgtttgctaatggtct

SEQ ID NO: 235286 - DNA, 25 bp, Artificial sequence
  SiRNA target sequence
atttatgacgtttgctaatggtctt

SEQ ID NO: 235287 - DNA, 25 bp, Artificial sequence
  SiRNA target sequence
tttatgacgtttgctaatggtcttt

SEQ ID NO: 235288 - DNA, 25 bp, Artificial sequence
  SiRNA target sequence
ttatgacgtttgctaatggtctttc

SEQ ID NO: 235289 - DNA, 25 bp, Artificial sequence
  SiRNA target sequence
tatgacgtttgctaatggtctttcg

SEQ ID NO: 235290 - DNA, 25 bp, Artificial sequence
  SiRNA target sequence
atgacgtttgctaatggtctttcga

SEQ ID NO: 235291 - DNA, 25 bp, Artificial sequence
  SiRNA target sequence
tgacgtttgctaatggtctttcgac

SEQ ID NO: 235292 - DNA, 25 bp, Artificial sequence
  SiRNA target sequence
gacgtttgctaatggtctttcgact

SEQ ID NO: 235293 - DNA, 25 bp, Artificial sequence
  SiRNA target sequence
acgtttgctaatggtctttcgactc

SEQ ID NO: 235294 - DNA, 25 bp, Artificial sequence
  SiRNA target sequence
cgtttgctaatggtctttcgactcc

SEQ ID NO: 235295 - DNA, 25 bp, Artificial sequence
  SiRNA target sequence
gtttgctaatggtctttcgactcct

SEQ ID NO: 235296 - DNA, 25 bp, Artificial sequence
  SiRNA target sequence
tttgctaatggtctttcgactcctg

SEQ ID NO: 235297 - DNA, 25 bp, Artificial sequence
  SiRNA target sequence
ttgctaatggtctttcgactcctgg

SEQ ID NO: 235298 - DNA, 25 bp, Artificial sequence
  SiRNA target sequence
tgctaatggtctttcgactcctgga

SEQ ID NO: 235299 - DNA, 25 bp, Artificial sequence
  SiRNA target sequence
gctaatggtctttcgactcctggac

SEQ ID NO: 235300 - DNA, 25 bp, Artificial sequence
  SiRNA target sequence
ctaatggtctttcgactcctggaca

SEQ ID NO: 235301 - DNA, 25 bp, Artificial sequence
  SiRNA target sequence
taatggtctttcgactcctggacag

SEQ ID NO: 235302 - DNA, 25 bp, Artificial sequence
  SiRNA target sequence
aatggtctttcgactcctggacagt

SEQ ID NO: 235303 - DNA, 25 bp, Artificial sequence
  SiRNA target sequence
atggtctttcgactcctggacagtc

SEQ ID NO: 235304 - DNA, 25 bp, Artificial sequence
  SiRNA target sequence
tggtctttcgactcctggacagtcc

SEQ ID NO: 235305 - DNA, 25 bp, Artificial sequence
  SiRNA target sequence
ggtctttcgactcctggacagtccg

SEQ ID NO: 235306 - DNA, 25 bp, Artificial sequence
  SiRNA target sequence
gtctttcgactcctggacagtccgc

SEQ ID NO: 235307 - DNA, 25 bp, Artificial sequence
  SiRNA target sequence
tctttcgactcctggacagtccgct

SEQ ID NO: 235308 - DNA, 25 bp, Artificial sequence
  SiRNA target sequence
ctttcgactcctggacagtccgcta

SEQ ID NO: 235309 - DNA, 25 bp, Artificial sequence
  SiRNA target sequence
tttcgactcctggacagtccgctag

SEQ ID NO: 235310 - DNA, 25 bp, Artificial sequence
  SiRNA target sequence
ttcgactcctggacagtccgctaga

SEQ ID NO: 235311 - DNA, 25 bp, Artificial sequence
  SiRNA target sequence
tcgactcctggacagtccgctagat

SEQ ID NO: 235312 - DNA, 25 bp, Artificial sequence
  SiRNA target sequence
cgactcctggacagtccgctagatt

SEQ ID NO: 235313 - DNA, 25 bp, Artificial sequence
  SiRNA target sequence
gactcctggacagtccgctagattt

SEQ ID NO: 235314 - DNA, 25 bp, Artificial sequence
  SiRNA target sequence
actcctggacagtccgctagatttg

SEQ ID NO: 235315 - DNA, 25 bp, Artificial sequence
  SiRNA target sequence
ctcctggacagtccgctagatttgt

SEQ ID NO: 235316 - DNA, 25 bp, Artificial sequence
  SiRNA target sequence
tcctggacagtccgctagatttgtc

SEQ ID NO: 235317 - DNA, 25 bp, Artificial sequence
  SiRNA target sequence
cctggacagtccgctagatttgtcc

SEQ ID NO: 235318 - DNA, 25 bp, Artificial sequence
  SiRNA target sequence
ctggacagtccgctagatttgtccc

SEQ ID NO: 235319 - DNA, 25 bp, Artificial sequence
  SiRNA target sequence
tggacagtccgctagatttgtccct

SEQ ID NO: 235320 - DNA, 25 bp, Artificial sequence
  SiRNA target sequence
ggacagtccgctagatttgtccctt

SEQ ID NO: 235321 - DNA, 25 bp, Artificial sequence
  SiRNA target sequence
gacagtccgctagatttgtcccttt

SEQ ID NO: 235322 - DNA, 25 bp, Artificial sequence
  SiRNA target sequence
acagtccgctagatttgtcccttta

SEQ ID NO: 235323 - DNA, 25 bp, Artificial sequence
  SiRNA target sequence
cagtccgctagatttgtccctttat

SEQ ID NO: 235324 - DNA, 25 bp, Artificial sequence
  SiRNA target sequence
agtccgctagatttgtccctttatt

SEQ ID NO: 235325 - DNA, 25 bp, Artificial sequence
  SiRNA target sequence
gtccgctagatttgtccctttattt

SEQ ID NO: 235326 - DNA, 25 bp, Artificial sequence
  SiRNA target sequence
tccgctagatttgtccctttatttt

SEQ ID NO: 235327 - DNA, 25 bp, Artificial sequence
  SiRNA target sequence
ccgctagatttgtccctttatttta

SEQ ID NO: 235328 - DNA, 25 bp, Artificial sequence
  SiRNA target sequence
cgctagatttgtccctttattttat

SEQ ID NO: 235329 - DNA, 25 bp, Artificial sequence
  SiRNA target sequence
gctagatttgtccctttattttatg

SEQ ID NO: 235330 - DNA, 25 bp, Artificial sequence
  SiRNA target sequence
ctagatttgtccctttattttatgt

SEQ ID NO: 235331 - DNA, 25 bp, Artificial sequence
  SiRNA target sequence
tagatttgtccctttattttatgtt

SEQ ID NO: 235332 - DNA, 25 bp, Artificial sequence
  SiRNA target sequence
agatttgtccctttattttatgttg

SEQ ID NO: 235333 - DNA, 25 bp, Artificial sequence
  SiRNA target sequence
gatttgtccctttattttatgttgg

SEQ ID NO: 235334 - DNA, 25 bp, Artificial sequence
  SiRNA target sequence
atttgtccctttattttatgttgga

SEQ ID NO: 235335 - DNA, 25 bp, Artificial sequence
  SiRNA target sequence
tttgtccctttattttatgttggat

SEQ ID NO: 235336 - DNA, 25 bp, Artificial sequence
  SiRNA target sequence
ttgtccctttattttatgttggatc

SEQ ID NO: 235337 - DNA, 25 bp, Artificial sequence
  SiRNA target sequence
tgtccctttattttatgttggatct

SEQ ID NO: 235338 - DNA, 25 bp, Artificial sequence
  SiRNA target sequence
gtccctttattttatgttggatcta

SEQ ID NO: 235339 - DNA, 25 bp, Artificial sequence
  SiRNA target sequence
tccctttattttatgttggatctaa

SEQ ID NO: 235340 - DNA, 25 bp, Artificial sequence
  SiRNA target sequence
ccctttattttatgttggatctaat

SEQ ID NO: 235341 - DNA, 25 bp, Artificial sequence
  SiRNA target sequence
cctttattttatgttggatctaatt

SEQ ID NO: 235342 - DNA, 25 bp, Artificial sequence
  SiRNA target sequence
ctttattttatgttggatctaattt

SEQ ID NO: 235343 - DNA, 25 bp, Artificial sequence
  SiRNA target sequence
tttattttatgttggatctaatttg

SEQ ID NO: 235344 - DNA, 25 bp, Artificial sequence
  SiRNA target sequence
ttattttatgttggatctaatttgg

SEQ ID NO: 235345 - DNA, 25 bp, Artificial sequence
  SiRNA target sequence
tattttatgttggatctaatttggc

SEQ ID NO: 235346 - DNA, 25 bp, Artificial sequence
  SiRNA target sequence
attttatgttggatctaatttggct

SEQ ID NO: 235347 - DNA, 25 bp, Artificial sequence
  SiRNA target sequence
ttttatgttggatctaatttggctt

SEQ ID NO: 235348 - DNA, 25 bp, Artificial sequence
  SiRNA target sequence
tttatgttggatctaatttggcttt

SEQ ID NO: 235349 - DNA, 25 bp, Artificial sequence
  SiRNA target sequence
ttatgttggatctaatttggcttta

SEQ ID NO: 235350 - DNA, 25 bp, Artificial sequence
  SiRNA target sequence
tatgttggatctaatttggctttac

SEQ ID NO: 235351 - DNA, 25 bp, Artificial sequence
  SiRNA target sequence
atgttggatctaatttggctttact

SEQ ID NO: 235352 - DNA, 25 bp, Artificial sequence
  SiRNA target sequence
tgttggatctaatttggctttactt

SEQ ID NO: 235353 - DNA, 25 bp, Artificial sequence
  SiRNA target sequence
gttggatctaatttggctttacttc

SEQ ID NO: 235354 - DNA, 25 bp, Artificial sequence
  SiRNA target sequence
ttggatctaatttggctttacttct

SEQ ID NO: 235355 - DNA, 25 bp, Artificial sequence
  SiRNA target sequence
tggatctaatttggctttacttctt

SEQ ID NO: 235356 - DNA, 25 bp, Artificial sequence
  SiRNA target sequence
ggatctaatttggctttacttcttt

SEQ ID NO: 235357 - DNA, 25 bp, Artificial sequence
  SiRNA target sequence
gatctaatttggctttacttctttc

SEQ ID NO: 235358 - DNA, 25 bp, Artificial sequence
  SiRNA target sequence
atctaatttggctttacttctttca

SEQ ID NO: 235359 - DNA, 25 bp, Artificial sequence
  SiRNA target sequence
tctaatttggctttacttctttcag

SEQ ID NO: 235360 - DNA, 25 bp, Artificial sequence
  SiRNA target sequence
ctaatttggctttacttctttcagg

SEQ ID NO: 235361 - DNA, 25 bp, Artificial sequence
  SiRNA target sequence
taatttggctttacttctttcagga

SEQ ID NO: 235362 - DNA, 25 bp, Artificial sequence
  SiRNA target sequence
aatttggctttacttctttcaggaa

SEQ ID NO: 235363 - DNA, 25 bp, Artificial sequence
  SiRNA target sequence
atttggctttacttctttcaggaat

SEQ ID NO: 235364 - DNA, 25 bp, Artificial sequence
  SiRNA target sequence
tttggctttacttctttcaggaatg

SEQ ID NO: 235365 - DNA, 25 bp, Artificial sequence
  SiRNA target sequence
ttggctttacttctttcaggaatga

SEQ ID NO: 235366 - DNA, 25 bp, Artificial sequence
  SiRNA target sequence
tggctttacttctttcaggaatgat

SEQ ID NO: 235367 - DNA, 25 bp, Artificial sequence
  SiRNA target sequence
ggctttacttctttcaggaatgata

SEQ ID NO: 235368 - DNA, 25 bp, Artificial sequence
  SiRNA target sequence
gctttacttctttcaggaatgataa

SEQ ID NO: 235369 - DNA, 25 bp, Artificial sequence
  SiRNA target sequence
ctttacttctttcaggaatgataaa

SEQ ID NO: 235370 - DNA, 25 bp, Artificial sequence
  SiRNA target sequence
tttacttctttcaggaatgataaat

SEQ ID NO: 235371 - DNA, 25 bp, Artificial sequence
  SiRNA target sequence
ttacttctttcaggaatgataaatt

SEQ ID NO: 235372 - DNA, 25 bp, Artificial sequence
  SiRNA target sequence
tacttctttcaggaatgataaatta

SEQ ID NO: 235373 - DNA, 25 bp, Artificial sequence
  SiRNA target sequence
acttctttcaggaatgataaattac

SEQ ID NO: 235374 - DNA, 25 bp, Artificial sequence
  SiRNA target sequence
cttctttcaggaatgataaattact

SEQ ID NO: 235375 - DNA, 25 bp, Artificial sequence
  SiRNA target sequence
ttctttcaggaatgataaattactt

SEQ ID NO: 235376 - DNA, 25 bp, Artificial sequence
  SiRNA target sequence
tctttcaggaatgataaattacttt

SEQ ID NO: 235377 - DNA, 25 bp, Artificial sequence
  SiRNA target sequence
ctttcaggaatgataaattactttt

SEQ ID NO: 235378 - DNA, 25 bp, Artificial sequence
  SiRNA target sequence
tttcaggaatgataaattactttta

SEQ ID NO: 235379 - DNA, 25 bp, Artificial sequence
  SiRNA target sequence
ttcaggaatgataaattacttttat

SEQ ID NO: 235380 - DNA, 25 bp, Artificial sequence
  SiRNA target sequence
tcaggaatgataaattacttttata

SEQ ID NO: 235381 - DNA, 25 bp, Artificial sequence
  SiRNA target sequence
caggaatgataaattacttttatag

SEQ ID NO: 235382 - DNA, 25 bp, Artificial sequence
  SiRNA target sequence
aggaatgataaattacttttatagt

SEQ ID NO: 235383 - DNA, 25 bp, Artificial sequence
  SiRNA target sequence
ggaatgataaattacttttatagtg

SEQ ID NO: 235384 - DNA, 25 bp, Artificial sequence
  SiRNA target sequence
gaatgataaattacttttatagtgt

SEQ ID NO: 235385 - DNA, 25 bp, Artificial sequence
  SiRNA target sequence
aatgataaattacttttatagtgta

SEQ ID NO: 235386 - DNA, 25 bp, Artificial sequence
  SiRNA target sequence
atgataaattacttttatagtgtaa

SEQ ID NO: 235387 - DNA, 25 bp, Artificial sequence
  SiRNA target sequence
tgataaattacttttatagtgtaag

SEQ ID NO: 235388 - DNA, 25 bp, Artificial sequence
  SiRNA target sequence
gataaattacttttatagtgtaagt

SEQ ID NO: 235389 - DNA, 25 bp, Artificial sequence
  SiRNA target sequence
ataaattacttttatagtgtaagta

SEQ ID NO: 235390 - DNA, 25 bp, Artificial sequence
  SiRNA target sequence
taaattacttttatagtgtaagtaa

SEQ ID NO: 235391 - DNA, 25 bp, Artificial sequence
  SiRNA target sequence
aaattacttttatagtgtaagtaaa

SEQ ID NO: 235392 - DNA, 25 bp, Artificial sequence
  SiRNA target sequence
aattacttttatagtgtaagtaaat

SEQ ID NO: 235393 - DNA, 25 bp, Artificial sequence
  SiRNA target sequence
attacttttatagtgtaagtaaatc

SEQ ID NO: 235394 - DNA, 25 bp, Artificial sequence
  SiRNA target sequence
ttacttttatagtgtaagtaaatct

SEQ ID NO: 235395 - DNA, 25 bp, Artificial sequence
  SiRNA target sequence
tacttttatagtgtaagtaaatcta

SEQ ID NO: 235396 - DNA, 25 bp, Artificial sequence
  SiRNA target sequence
acttttatagtgtaagtaaatctaa

SEQ ID NO: 235397 - DNA, 25 bp, Artificial sequence
  SiRNA target sequence
cttttatagtgtaagtaaatctaaa

SEQ ID NO: 235398 - DNA, 25 bp, Artificial sequence
  SiRNA target sequence
ttttatagtgtaagtaaatctaaaa

SEQ ID NO: 235399 - DNA, 25 bp, Artificial sequence
  SiRNA target sequence
tttatagtgtaagtaaatctaaaat

SEQ ID NO: 235400 - DNA, 25 bp, Artificial sequence
  SiRNA target sequence
ttatagtgtaagtaaatctaaaatg

SEQ ID NO: 235401 - DNA, 25 bp, Artificial sequence
  SiRNA target sequence
tatagtgtaagtaaatctaaaatgt

SEQ ID NO: 235402 - DNA, 25 bp, Artificial sequence
  SiRNA target sequence
atagtgtaagtaaatctaaaatgtc

SEQ ID NO: 235403 - DNA, 25 bp, Artificial sequence
  SiRNA target sequence
tagtgtaagtaaatctaaaatgtcg

SEQ ID NO: 235404 - DNA, 25 bp, Artificial sequence
  SiRNA target sequence
agtgtaagtaaatctaaaatgtcgt

SEQ ID NO: 235405 - DNA, 25 bp, Artificial sequence
  SiRNA target sequence
gtgtaagtaaatctaaaatgtcgta

SEQ ID NO: 235406 - DNA, 25 bp, Artificial sequence
  SiRNA target sequence
tgtaagtaaatctaaaatgtcgtat

SEQ ID NO: 235407 - DNA, 25 bp, Artificial sequence
  SiRNA target sequence
gtaagtaaatctaaaatgtcgtatg

SEQ ID NO: 235408 - DNA, 25 bp, Artificial sequence
  SiRNA target sequence
taagtaaatctaaaatgtcgtatgt

SEQ ID NO: 235409 - DNA, 25 bp, Artificial sequence
  SiRNA target sequence
aagtaaatctaaaatgtcgtatgtt

SEQ ID NO: 235410 - DNA, 25 bp, Artificial sequence
  SiRNA target sequence
agtaaatctaaaatgtcgtatgttg

SEQ ID NO: 235411 - DNA, 25 bp, Artificial sequence
  SiRNA target sequence
gtaaatctaaaatgtcgtatgttgc

SEQ ID NO: 235412 - DNA, 25 bp, Artificial sequence
  SiRNA target sequence
taaatctaaaatgtcgtatgttgcg

SEQ ID NO: 235413 - DNA, 25 bp, Artificial sequence
  SiRNA target sequence
aaatctaaaatgtcgtatgttgcgg

SEQ ID NO: 235414 - DNA, 25 bp, Artificial sequence
  SiRNA target sequence
aatctaaaatgtcgtatgttgcggc

SEQ ID NO: 235415 - DNA, 25 bp, Artificial sequence
  SiRNA target sequence
atctaaaatgtcgtatgttgcggcc

SEQ ID NO: 235416 - DNA, 25 bp, Artificial sequence
  SiRNA target sequence
tctaaaatgtcgtatgttgcggccg

SEQ ID NO: 235417 - DNA, 25 bp, Artificial sequence
  SiRNA target sequence
ctaaaatgtcgtatgttgcggccga

SEQ ID NO: 235418 - DNA, 25 bp, Artificial sequence
  SiRNA target sequence
taaaatgtcgtatgttgcggccgaa

SEQ ID NO: 235419 - DNA, 25 bp, Artificial sequence
  SiRNA target sequence
aaaatgtcgtatgttgcggccgaaa

SEQ ID NO: 235420 - DNA, 25 bp, Artificial sequence
  SiRNA target sequence
aaatgtcgtatgttgcggccgaaag

SEQ ID NO: 235421 - DNA, 25 bp, Artificial sequence
  SiRNA target sequence
aatgtcgtatgttgcggccgaaaga

SEQ ID NO: 235422 - DNA, 25 bp, Artificial sequence
  SiRNA target sequence
atgtcgtatgttgcggccgaaagat

SEQ ID NO: 235423 - DNA, 25 bp, Artificial sequence
  SiRNA target sequence
tgtcgtatgttgcggccgaaagatt

SEQ ID NO: 235424 - DNA, 25 bp, Artificial sequence
  SiRNA target sequence
gtcgtatgttgcggccgaaagattt

SEQ ID NO: 235425 - DNA, 25 bp, Artificial sequence
  SiRNA target sequence
tcgtatgttgcggccgaaagatttt

SEQ ID NO: 235426 - DNA, 25 bp, Artificial sequence
  SiRNA target sequence
cgtatgttgcggccgaaagattttt

SEQ ID NO: 235427 - DNA, 25 bp, Artificial sequence
  SiRNA target sequence
gtatgttgcggccgaaagatttttt

SEQ ID NO: 235428 - DNA, 25 bp, Artificial sequence
  SiRNA target sequence
tatgttgcggccgaaagatttttta

SEQ ID NO: 235429 - DNA, 25 bp, Artificial sequence
  SiRNA target sequence
atgttgcggccgaaagattttttaa

SEQ ID NO: 235430 - DNA, 25 bp, Artificial sequence
  SiRNA target sequence
tgttgcggccgaaagattttttaat

SEQ ID NO: 235431 - DNA, 25 bp, Artificial sequence
  SiRNA target sequence
gttgcggccgaaagattttttaatg

SEQ ID NO: 235432 - DNA, 25 bp, Artificial sequence
  SiRNA target sequence
ttgcggccgaaagattttttaatgg

SEQ ID NO: 235433 - DNA, 25 bp, Artificial sequence
  SiRNA target sequence
tgcggccgaaagattttttaatgga

SEQ ID NO: 235434 - DNA, 25 bp, Artificial sequence
  SiRNA target sequence
gcggccgaaagattttttaatggat

SEQ ID NO: 235435 - DNA, 25 bp, Artificial sequence
  SiRNA target sequence
cggccgaaagattttttaatggatt

SEQ ID NO: 235436 - DNA, 25 bp, Artificial sequence
  SiRNA target sequence
ggccgaaagattttttaatggattt

SEQ ID NO: 235437 - DNA, 25 bp, Artificial sequence
  SiRNA target sequence
gccgaaagattttttaatggatttt

SEQ ID NO: 235438 - DNA, 25 bp, Artificial sequence
  SiRNA target sequence
ccgaaagattttttaatggattttt

SEQ ID NO: 235439 - DNA, 25 bp, Artificial sequence
  SiRNA target sequence
cgaaagattttttaatggatttttt

SEQ ID NO: 235440 - DNA, 25 bp, Artificial sequence
  SiRNA target sequence
gaaagattttttaatggattttttt

SEQ ID NO: 235441 - DNA, 25 bp, Artificial sequence
  SiRNA target sequence
aaagattttttaatggatttttttg

SEQ ID NO: 235442 - DNA, 25 bp, Artificial sequence
  SiRNA target sequence
aagattttttaatggatttttttgt

SEQ ID NO: 235443 - DNA, 25 bp, Artificial sequence
  SiRNA target sequence
agattttttaatggatttttttgtc

SEQ ID NO: 235444 - DNA, 25 bp, Artificial sequence
  SiRNA target sequence
gattttttaatggatttttttgtct

SEQ ID NO: 235445 - DNA, 25 bp, Artificial sequence
  SiRNA target sequence
attttttaatggatttttttgtctg

SEQ ID NO: 235446 - DNA, 25 bp, Artificial sequence
  SiRNA target sequence
ttttttaatggatttttttgtctga

SEQ ID NO: 235447 - DNA, 25 bp, Artificial sequence
  SiRNA target sequence
tttttaatggatttttttgtctgag

SEQ ID NO: 235448 - DNA, 25 bp, Artificial sequence
  SiRNA target sequence
ttttaatggatttttttgtctgagt

SEQ ID NO: 235449 - DNA, 25 bp, Artificial sequence
  SiRNA target sequence
tttaatggatttttttgtctgagtg

SEQ ID NO: 235450 - DNA, 25 bp, Artificial sequence
  SiRNA target sequence
ttaatggatttttttgtctgagtgg

SEQ ID NO: 235451 - DNA, 25 bp, Artificial sequence
  SiRNA target sequence
taatggatttttttgtctgagtgga

SEQ ID NO: 235452 - DNA, 25 bp, Artificial sequence
  SiRNA target sequence
aatggatttttttgtctgagtggaa

SEQ ID NO: 235453 - DNA, 25 bp, Artificial sequence
  SiRNA target sequence
atggatttttttgtctgagtggaat

SEQ ID NO: 235454 - DNA, 25 bp, Artificial sequence
  SiRNA target sequence
tggatttttttgtctgagtggaatt

SEQ ID NO: 235455 - DNA, 25 bp, Artificial sequence
  SiRNA target sequence
ggatttttttgtctgagtggaattc

SEQ ID NO: 235456 - DNA, 25 bp, Artificial sequence
  SiRNA target sequence
gatttttttgtctgagtggaattct

SEQ ID NO: 235457 - DNA, 25 bp, Artificial sequence
  SiRNA target sequence
atttttttgtctgagtggaattctc

SEQ ID NO: 235458 - DNA, 25 bp, Artificial sequence
  SiRNA target sequence
tttttttgtctgagtggaattctct

SEQ ID NO: 235459 - DNA, 25 bp, Artificial sequence
  SiRNA target sequence
ttttttgtctgagtggaattctctg

SEQ ID NO: 235460 - DNA, 25 bp, Artificial sequence
  SiRNA target sequence
tttttgtctgagtggaattctctgt

SEQ ID NO: 235461 - DNA, 25 bp, Artificial sequence
  SiRNA target sequence
ttttgtctgagtggaattctctgtg

SEQ ID NO: 235462 - DNA, 25 bp, Artificial sequence
  SiRNA target sequence
tttgtctgagtggaattctctgtgc

SEQ ID NO: 235463 - DNA, 25 bp, Artificial sequence
  SiRNA target sequence
ttgtctgagtggaattctctgtgct

SEQ ID NO: 235464 - DNA, 25 bp, Artificial sequence
  SiRNA target sequence
tgtctgagtggaattctctgtgctg

SEQ ID NO: 235465 - DNA, 25 bp, Artificial sequence
  SiRNA target sequence
gtctgagtggaattctctgtgctgt

SEQ ID NO: 235466 - DNA, 25 bp, Artificial sequence
  SiRNA target sequence
tctgagtggaattctctgtgctgta

SEQ ID NO: 235467 - DNA, 25 bp, Artificial sequence
  SiRNA target sequence
ctgagtggaattctctgtgctgtaa

SEQ ID NO: 235468 - DNA, 25 bp, Artificial sequence
  SiRNA target sequence
tgagtggaattctctgtgctgtaat

SEQ ID NO: 235469 - DNA, 25 bp, Artificial sequence
  SiRNA target sequence
gagtggaattctctgtgctgtaatt

SEQ ID NO: 235470 - DNA, 25 bp, Artificial sequence
  SiRNA target sequence
agtggaattctctgtgctgtaattt

SEQ ID NO: 235471 - DNA, 25 bp, Artificial sequence
  SiRNA target sequence
gtggaattctctgtgctgtaattta

SEQ ID NO: 235472 - DNA, 25 bp, Artificial sequence
  SiRNA target sequence
tggaattctctgtgctgtaatttat

SEQ ID NO: 235473 - DNA, 25 bp, Artificial sequence
  SiRNA target sequence
ggaattctctgtgctgtaatttatc

SEQ ID NO: 235474 - DNA, 25 bp, Artificial sequence
  SiRNA target sequence
gaattctctgtgctgtaatttatct

SEQ ID NO: 235475 - DNA, 25 bp, Artificial sequence
  SiRNA target sequence
aattctctgtgctgtaatttatctt

SEQ ID NO: 235476 - DNA, 25 bp, Artificial sequence
  SiRNA target sequence
attctctgtgctgtaatttatcttc

SEQ ID NO: 235477 - DNA, 25 bp, Artificial sequence
  SiRNA target sequence
ttctctgtgctgtaatttatcttct

SEQ ID NO: 235478 - DNA, 25 bp, Artificial sequence
  SiRNA target sequence
tctctgtgctgtaatttatcttcta

SEQ ID NO: 235479 - DNA, 25 bp, Artificial sequence
  SiRNA target sequence
ctctgtgctgtaatttatcttctaa

SEQ ID NO: 235480 - DNA, 25 bp, Artificial sequence
  SiRNA target sequence
tctgtgctgtaatttatcttctaaa

SEQ ID NO: 235481 - DNA, 25 bp, Artificial sequence
  SiRNA target sequence
ctgtgctgtaatttatcttctaaaa

SEQ ID NO: 235482 - DNA, 25 bp, Artificial sequence
  SiRNA target sequence
tgtgctgtaatttatcttctaaaaa

SEQ ID NO: 235483 - DNA, 25 bp, Artificial sequence
  SiRNA target sequence
gtgctgtaatttatcttctaaaaaa

SEQ ID NO: 235484 - DNA, 25 bp, Artificial sequence
  SiRNA target sequence
tgctgtaatttatcttctaaaaaaa

SEQ ID NO: 235485 - DNA, 25 bp, Artificial sequence
  SiRNA target sequence
gctgtaatttatcttctaaaaaaat

SEQ ID NO: 235486 - DNA, 25 bp, Artificial sequence
  SiRNA target sequence
ctgtaatttatcttctaaaaaaata

SEQ ID NO: 235487 - DNA, 25 bp, Artificial sequence
  SiRNA target sequence
tgtaatttatcttctaaaaaaatat

SEQ ID NO: 235488 - DNA, 25 bp, Artificial sequence
  SiRNA target sequence
gtaatttatcttctaaaaaaatatt

SEQ ID NO: 235489 - DNA, 25 bp, Artificial sequence
  SiRNA target sequence
taatttatcttctaaaaaaatattt

SEQ ID NO: 235490 - DNA, 25 bp, Artificial sequence
  SiRNA target sequence
aatttatcttctaaaaaaatattta

SEQ ID NO: 235491 - DNA, 25 bp, Artificial sequence
  SiRNA target sequence
atttatcttctaaaaaaatatttag

SEQ ID NO: 235492 - DNA, 25 bp, Artificial sequence
  SiRNA target sequence
tttatcttctaaaaaaatatttaga

SEQ ID NO: 235493 - DNA, 25 bp, Artificial sequence
  SiRNA target sequence
ttatcttctaaaaaaatatttagaa

SEQ ID NO: 235494 - DNA, 25 bp, Artificial sequence
  SiRNA target sequence
tatcttctaaaaaaatatttagaaa

SEQ ID NO: 235495 - DNA, 25 bp, Artificial sequence
  SiRNA target sequence
atcttctaaaaaaatatttagaaaa

SEQ ID NO: 235496 - DNA, 25 bp, Artificial sequence
  SiRNA target sequence
tcttctaaaaaaatatttagaaaat

SEQ ID NO: 235497 - DNA, 25 bp, Artificial sequence
  SiRNA target sequence
cttctaaaaaaatatttagaaaata

SEQ ID NO: 235498 - DNA, 25 bp, Artificial sequence
  SiRNA target sequence
ttctaaaaaaatatttagaaaataa

SEQ ID NO: 235499 - DNA, 25 bp, Artificial sequence
  SiRNA target sequence
tctaaaaaaatatttagaaaataat

SEQ ID NO: 235500 - DNA, 25 bp, Artificial sequence
  SiRNA target sequence
ctaaaaaaatatttagaaaataatg

SEQ ID NO: 235501 - DNA, 25 bp, Artificial sequence
  SiRNA target sequence
taaaaaaatatttagaaaataatgt

SEQ ID NO: 235502 - DNA, 25 bp, Artificial sequence
  SiRNA target sequence
aaaaaaatatttagaaaataatgtt

SEQ ID NO: 235503 - DNA, 25 bp, Artificial sequence
  SiRNA target sequence
aaaaaatatttagaaaataatgtta

SEQ ID NO: 235504 - DNA, 25 bp, Artificial sequence
  SiRNA target sequence
aaaaatatttagaaaataatgttac

SEQ ID NO: 235505 - DNA, 25 bp, Artificial sequence
  SiRNA target sequence
aaaatatttagaaaataatgttact

SEQ ID NO: 235506 - DNA, 25 bp, Artificial sequence
  SiRNA target sequence
aaatatttagaaaataatgttacta

SEQ ID NO: 235507 - DNA, 25 bp, Artificial sequence
  SiRNA target sequence
aatatttagaaaataatgttactag

SEQ ID NO: 235508 - DNA, 25 bp, Artificial sequence
  SiRNA target sequence
atatttagaaaataatgttactagc

SEQ ID NO: 235509 - DNA, 25 bp, Artificial sequence
  SiRNA target sequence
tatttagaaaataatgttactagca

SEQ ID NO: 235510 - DNA, 25 bp, Artificial sequence
  SiRNA target sequence
atttagaaaataatgttactagcaa

SEQ ID NO: 235511 - DNA, 25 bp, Artificial sequence
  SiRNA target sequence
tttagaaaataatgttactagcaaa

SEQ ID NO: 235512 - DNA, 25 bp, Artificial sequence
  SiRNA target sequence
ttagaaaataatgttactagcaaac

SEQ ID NO: 235513 - DNA, 25 bp, Artificial sequence
  SiRNA target sequence
tagaaaataatgttactagcaaacc

SEQ ID NO: 235514 - DNA, 25 bp, Artificial sequence
  SiRNA target sequence
agaaaataatgttactagcaaacca

SEQ ID NO: 235515 - DNA, 25 bp, Artificial sequence
  SiRNA target sequence
gaaaataatgttactagcaaaccaa

SEQ ID NO: 235516 - DNA, 25 bp, Artificial sequence
  SiRNA target sequence
aaaataatgttactagcaaaccaat

SEQ ID NO: 235517 - DNA, 25 bp, Artificial sequence
  SiRNA target sequence
aaataatgttactagcaaaccaatg

SEQ ID NO: 235518 - DNA, 25 bp, Artificial sequence
  SiRNA target sequence
aataatgttactagcaaaccaatgt

SEQ ID NO: 235519 - DNA, 25 bp, Artificial sequence
  SiRNA target sequence
ataatgttactagcaaaccaatgtt

SEQ ID NO: 235520 - DNA, 25 bp, Artificial sequence
  SiRNA target sequence
taatgttactagcaaaccaatgttt

SEQ ID NO: 235521 - DNA, 25 bp, Artificial sequence
  SiRNA target sequence
aatgttactagcaaaccaatgtttg

SEQ ID NO: 235522 - DNA, 25 bp, Artificial sequence
  SiRNA target sequence
atgttactagcaaaccaatgtttgt

SEQ ID NO: 235523 - DNA, 25 bp, Artificial sequence
  SiRNA target sequence
tgttactagcaaaccaatgtttgtt

SEQ ID NO: 235524 - DNA, 25 bp, Artificial sequence
  SiRNA target sequence
gttactagcaaaccaatgtttgtta

SEQ ID NO: 235525 - DNA, 25 bp, Artificial sequence
  SiRNA target sequence
ttactagcaaaccaatgtttgttag

SEQ ID NO: 235526 - DNA, 25 bp, Artificial sequence
  SiRNA target sequence
tactagcaaaccaatgtttgttaga

SEQ ID NO: 235527 - DNA, 25 bp, Artificial sequence
  SiRNA target sequence
actagcaaaccaatgtttgttagaa

SEQ ID NO: 235528 - DNA, 25 bp, Artificial sequence
  SiRNA target sequence
ctagcaaaccaatgtttgttagaaa

SEQ ID NO: 235529 - DNA, 25 bp, Artificial sequence
  SiRNA target sequence
tagcaaaccaatgtttgttagaaag

SEQ ID NO: 235530 - DNA, 25 bp, Artificial sequence
  SiRNA target sequence
agcaaaccaatgtttgttagaaaga

SEQ ID NO: 235531 - DNA, 25 bp, Artificial sequence
  SiRNA target sequence
gcaaaccaatgtttgttagaaagac

SEQ ID NO: 235532 - DNA, 25 bp, Artificial sequence
  SiRNA target sequence
caaaccaatgtttgttagaaagact

SEQ ID NO: 235533 - DNA, 25 bp, Artificial sequence
  SiRNA target sequence
aaaccaatgtttgttagaaagactt

SEQ ID NO: 235534 - DNA, 25 bp, Artificial sequence
  SiRNA target sequence
aaccaatgtttgttagaaagacttt

SEQ ID NO: 235535 - DNA, 25 bp, Artificial sequence
  SiRNA target sequence
accaatgtttgttagaaagactttt

SEQ ID NO: 235536 - DNA, 25 bp, Artificial sequence
  SiRNA target sequence
ccaatgtttgttagaaagactttta

SEQ ID NO: 235537 - DNA, 25 bp, Artificial sequence
  SiRNA target sequence
caatgtttgttagaaagacttttac

SEQ ID NO: 235538 - DNA, 25 bp, Artificial sequence
  SiRNA target sequence
aatgtttgttagaaagacttttact

SEQ ID NO: 235539 - DNA, 25 bp, Artificial sequence
  SiRNA target sequence
atgtttgttagaaagacttttacta

SEQ ID NO: 235540 - DNA, 25 bp, Artificial sequence
  SiRNA target sequence
tgtttgttagaaagacttttactaa

SEQ ID NO: 235541 - DNA, 25 bp, Artificial sequence
  SiRNA target sequence
gtttgttagaaagacttttactaaa

SEQ ID NO: 235542 - DNA, 25 bp, Artificial sequence
  SiRNA target sequence
tttgttagaaagacttttactaaaa

SEQ ID NO: 235543 - DNA, 25 bp, Artificial sequence
  SiRNA target sequence
ttgttagaaagacttttactaaaaa

SEQ ID NO: 235544 - DNA, 25 bp, Artificial sequence
  SiRNA target sequence
tgttagaaagacttttactaaaaag

SEQ ID NO: 235545 - DNA, 25 bp, Artificial sequence
  SiRNA target sequence
gttagaaagacttttactaaaaaga

SEQ ID NO: 235546 - DNA, 25 bp, Artificial sequence
  SiRNA target sequence
ttagaaagacttttactaaaaagaa

SEQ ID NO: 235547 - DNA, 25 bp, Artificial sequence
  SiRNA target sequence
tagaaagacttttactaaaaagaag

SEQ ID NO: 235548 - DNA, 25 bp, Artificial sequence
  SiRNA target sequence
agaaagacttttactaaaaagaaga

SEQ ID NO: 235549 - DNA, 25 bp, Artificial sequence
  SiRNA target sequence
gaaagacttttactaaaaagaagag

SEQ ID NO: 235550 - DNA, 25 bp, Artificial sequence
  SiRNA target sequence
aaagacttttactaaaaagaagagt

SEQ ID NO: 235551 - DNA, 25 bp, Artificial sequence
  SiRNA target sequence
aagacttttactaaaaagaagagta

SEQ ID NO: 235552 - DNA, 25 bp, Artificial sequence
  SiRNA target sequence
agacttttactaaaaagaagagtaa

SEQ ID NO: 235553 - DNA, 25 bp, Artificial sequence
  SiRNA target sequence
gacttttactaaaaagaagagtaaa

SEQ ID NO: 235554 - DNA, 25 bp, Artificial sequence
  SiRNA target sequence
acttttactaaaaagaagagtaaag

SEQ ID NO: 235555 - DNA, 25 bp, Artificial sequence
  SiRNA target sequence
cttttactaaaaagaagagtaaagt

SEQ ID NO: 235556 - DNA, 25 bp, Artificial sequence
  SiRNA target sequence
ttttactaaaaagaagagtaaagtg

SEQ ID NO: 235557 - DNA, 25 bp, Artificial sequence
  SiRNA target sequence
tttactaaaaagaagagtaaagtga

SEQ ID NO: 235558 - DNA, 25 bp, Artificial sequence
  SiRNA target sequence
ttactaaaaagaagagtaaagtgaa

SEQ ID NO: 235559 - DNA, 25 bp, Artificial sequence
  SiRNA target sequence
tactaaaaagaagagtaaagtgaag

SEQ ID NO: 235560 - DNA, 25 bp, Artificial sequence
  SiRNA target sequence
actaaaaagaagagtaaagtgaagg

SEQ ID NO: 235561 - DNA, 25 bp, Artificial sequence
  SiRNA target sequence
ctaaaaagaagagtaaagtgaaggt

SEQ ID NO: 235562 - DNA, 25 bp, Artificial sequence
  SiRNA target sequence
taaaaagaagagtaaagtgaaggtt

SEQ ID NO: 235563 - DNA, 25 bp, Artificial sequence
  SiRNA target sequence
aaaaagaagagtaaagtgaaggttg

SEQ ID NO: 235564 - DNA, 25 bp, Artificial sequence
  SiRNA target sequence
aaaagaagagtaaagtgaaggttgg

SEQ ID NO: 235565 - DNA, 25 bp, Artificial sequence
  SiRNA target sequence
aaagaagagtaaagtgaaggttgga

SEQ ID NO: 235566 - DNA, 25 bp, Artificial sequence
  SiRNA target sequence
aagaagagtaaagtgaaggttggat

SEQ ID NO: 235567 - DNA, 25 bp, Artificial sequence
  SiRNA target sequence
agaagagtaaagtgaaggttggatt

SEQ ID NO: 235568 - DNA, 25 bp, Artificial sequence
  SiRNA target sequence
gaagagtaaagtgaaggttggattt

SEQ ID NO: 235569 - DNA, 25 bp, Artificial sequence
  SiRNA target sequence
aagagtaaagtgaaggttggatttg

SEQ ID NO: 235570 - DNA, 25 bp, Artificial sequence
  SiRNA target sequence
agagtaaagtgaaggttggatttgt

SEQ ID NO: 235571 - DNA, 25 bp, Artificial sequence
  SiRNA target sequence
gagtaaagtgaaggttggatttgtt

SEQ ID NO: 235572 - DNA, 25 bp, Artificial sequence
  SiRNA target sequence
agtaaagtgaaggttggatttgttg

SEQ ID NO: 235573 - DNA, 25 bp, Artificial sequence
  SiRNA target sequence
gtaaagtgaaggttggatttgttga

SEQ ID NO: 235574 - DNA, 25 bp, Artificial sequence
  SiRNA target sequence
taaagtgaaggttggatttgttgat

SEQ ID NO: 235575 - DNA, 25 bp, Artificial sequence
  SiRNA target sequence
aaagtgaaggttggatttgttgatg

SEQ ID NO: 235576 - DNA, 25 bp, Artificial sequence
  SiRNA target sequence
aagtgaaggttggatttgttgatgg

SEQ ID NO: 235577 - DNA, 25 bp, Artificial sequence
  SiRNA target sequence
agtgaaggttggatttgttgatgga

SEQ ID NO: 235578 - DNA, 25 bp, Artificial sequence
  SiRNA target sequence
gtgaaggttggatttgttgatggac

SEQ ID NO: 235579 - DNA, 25 bp, Artificial sequence
  SiRNA target sequence
tgaaggttggatttgttgatggact

SEQ ID NO: 235580 - DNA, 25 bp, Artificial sequence
  SiRNA target sequence
gaaggttggatttgttgatggactt

SEQ ID NO: 235581 - DNA, 25 bp, Artificial sequence
  SiRNA target sequence
aaggttggatttgttgatggactta

SEQ ID NO: 235582 - DNA, 25 bp, Artificial sequence
  SiRNA target sequence
aggttggatttgttgatggacttat

SEQ ID NO: 235583 - DNA, 25 bp, Artificial sequence
  SiRNA target sequence
ggttggatttgttgatggacttatt

SEQ ID NO: 235584 - DNA, 25 bp, Artificial sequence
  SiRNA target sequence
gttggatttgttgatggacttattg

SEQ ID NO: 235585 - DNA, 25 bp, Artificial sequence
  SiRNA target sequence
ttggatttgttgatggacttattga

SEQ ID NO: 235586 - DNA, 25 bp, Artificial sequence
  SiRNA target sequence
tggatttgttgatggacttattgag

SEQ ID NO: 235587 - DNA, 25 bp, Artificial sequence
  SiRNA target sequence
ggatttgttgatggacttattgaga

SEQ ID NO: 235588 - DNA, 25 bp, Artificial sequence
  SiRNA target sequence
gatttgttgatggacttattgagat

SEQ ID NO: 235589 - DNA, 25 bp, Artificial sequence
  SiRNA target sequence
atttgttgatggacttattgagatg

SEQ ID NO: 235590 - DNA, 25 bp, Artificial sequence
  SiRNA target sequence
tttgttgatggacttattgagatga

SEQ ID NO: 235591 - DNA, 25 bp, Artificial sequence
  SiRNA target sequence
ttgttgatggacttattgagatgag

SEQ ID NO: 235592 - DNA, 25 bp, Artificial sequence
  SiRNA target sequence
tgttgatggacttattgagatgagt

SEQ ID NO: 235593 - DNA, 25 bp, Artificial sequence
  SiRNA target sequence
gttgatggacttattgagatgagta

SEQ ID NO: 235594 - DNA, 25 bp, Artificial sequence
  SiRNA target sequence
ttgatggacttattgagatgagtaa

SEQ ID NO: 235595 - DNA, 25 bp, Artificial sequence
  SiRNA target sequence
tgatggacttattgagatgagtaaa

SEQ ID NO: 235596 - DNA, 25 bp, Artificial sequence
  SiRNA target sequence
gatggacttattgagatgagtaaat

SEQ ID NO: 235597 - DNA, 25 bp, Artificial sequence
  SiRNA target sequence
atggacttattgagatgagtaaatc

SEQ ID NO: 235598 - DNA, 25 bp, Artificial sequence
  SiRNA target sequence
tggacttattgagatgagtaaatct

SEQ ID NO: 235599 - DNA, 25 bp, Artificial sequence
  SiRNA target sequence
ggacttattgagatgagtaaatcta

SEQ ID NO: 235600 - DNA, 25 bp, Artificial sequence
  SiRNA target sequence
gacttattgagatgagtaaatctaa

SEQ ID NO: 235601 - DNA, 25 bp, Artificial sequence
  SiRNA target sequence
acttattgagatgagtaaatctaaa

SEQ ID NO: 235602 - DNA, 25 bp, Artificial sequence
  SiRNA target sequence
cttattgagatgagtaaatctaaac

SEQ ID NO: 235603 - DNA, 25 bp, Artificial sequence
  SiRNA target sequence
ttattgagatgagtaaatctaaact

SEQ ID NO: 235604 - DNA, 25 bp, Artificial sequence
  SiRNA target sequence
tattgagatgagtaaatctaaacta

SEQ ID NO: 235605 - DNA, 25 bp, Artificial sequence
  SiRNA target sequence
attgagatgagtaaatctaaactac

SEQ ID NO: 235606 - DNA, 25 bp, Artificial sequence
  SiRNA target sequence
ttgagatgagtaaatctaaactact

SEQ ID NO: 235607 - DNA, 25 bp, Artificial sequence
  SiRNA target sequence
tgagatgagtaaatctaaactactg

SEQ ID NO: 235608 - DNA, 25 bp, Artificial sequence
  SiRNA target sequence
gagatgagtaaatctaaactactgt

SEQ ID NO: 235609 - DNA, 25 bp, Artificial sequence
  SiRNA target sequence
agatgagtaaatctaaactactgtt

SEQ ID NO: 235610 - DNA, 25 bp, Artificial sequence
  SiRNA target sequence
gatgagtaaatctaaactactgttg

SEQ ID NO: 235611 - DNA, 25 bp, Artificial sequence
  SiRNA target sequence
atgagtaaatctaaactactgttga

SEQ ID NO: 235612 - DNA, 25 bp, Artificial sequence
  SiRNA target sequence
tgagtaaatctaaactactgttgaa

SEQ ID NO: 235613 - DNA, 25 bp, Artificial sequence
  SiRNA target sequence
gagtaaatctaaactactgttgaat

SEQ ID NO: 235614 - DNA, 25 bp, Artificial sequence
  SiRNA target sequence
agtaaatctaaactactgttgaata

SEQ ID NO: 235615 - DNA, 25 bp, Artificial sequence
  SiRNA target sequence
gtaaatctaaactactgttgaatat

SEQ ID NO: 235616 - DNA, 25 bp, Artificial sequence
  SiRNA target sequence
taaatctaaactactgttgaatatg

SEQ ID NO: 235617 - DNA, 25 bp, Artificial sequence
  SiRNA target sequence
aaatctaaactactgttgaatatgt

SEQ ID NO: 235618 - DNA, 25 bp, Artificial sequence
  SiRNA target sequence
aatctaaactactgttgaatatgtc

SEQ ID NO: 235619 - DNA, 25 bp, Artificial sequence
  SiRNA target sequence
atctaaactactgttgaatatgtca

SEQ ID NO: 235620 - DNA, 25 bp, Artificial sequence
  SiRNA target sequence
tctaaactactgttgaatatgtcat

SEQ ID NO: 235621 - DNA, 25 bp, Artificial sequence
  SiRNA target sequence
ctaaactactgttgaatatgtcatt

SEQ ID NO: 235622 - DNA, 25 bp, Artificial sequence
  SiRNA target sequence
taaactactgttgaatatgtcatta

SEQ ID NO: 235623 - DNA, 25 bp, Artificial sequence
  SiRNA target sequence
aaactactgttgaatatgtcattag

SEQ ID NO: 235624 - DNA, 25 bp, Artificial sequence
  SiRNA target sequence
aactactgttgaatatgtcattagt

SEQ ID NO: 235625 - DNA, 25 bp, Artificial sequence
  SiRNA target sequence
actactgttgaatatgtcattagtc

SEQ ID NO: 235626 - DNA, 25 bp, Artificial sequence
  SiRNA target sequence
ctactgttgaatatgtcattagtcg

SEQ ID NO: 235627 - DNA, 25 bp, Artificial sequence
  SiRNA target sequence
tactgttgaatatgtcattagtcgt

SEQ ID NO: 235628 - DNA, 25 bp, Artificial sequence
  SiRNA target sequence
actgttgaatatgtcattagtcgta

SEQ ID NO: 235629 - DNA, 25 bp, Artificial sequence
  SiRNA target sequence
ctgttgaatatgtcattagtcgtat

SEQ ID NO: 235630 - DNA, 25 bp, Artificial sequence
  SiRNA target sequence
tgttgaatatgtcattagtcgtatt

SEQ ID NO: 235631 - DNA, 25 bp, Artificial sequence
  SiRNA target sequence
gttgaatatgtcattagtcgtatta

SEQ ID NO: 235632 - DNA, 25 bp, Artificial sequence
  SiRNA target sequence
ttgaatatgtcattagtcgtattat

SEQ ID NO: 235633 - DNA, 25 bp, Artificial sequence
  SiRNA target sequence
tgaatatgtcattagtcgtattatt

SEQ ID NO: 235634 - DNA, 25 bp, Artificial sequence
  SiRNA target sequence
gaatatgtcattagtcgtattattt

SEQ ID NO: 235635 - DNA, 25 bp, Artificial sequence
  SiRNA target sequence
aatatgtcattagtcgtattatttt

SEQ ID NO: 235636 - DNA, 25 bp, Artificial sequence
  SiRNA target sequence
atatgtcattagtcgtattatttta

SEQ ID NO: 235637 - DNA, 25 bp, Artificial sequence
  SiRNA target sequence
tatgtcattagtcgtattattttat

SEQ ID NO: 235638 - DNA, 25 bp, Artificial sequence
  SiRNA target sequence
atgtcattagtcgtattattttatg

SEQ ID NO: 235639 - DNA, 25 bp, Artificial sequence
  SiRNA target sequence
tgtcattagtcgtattattttatgc

SEQ ID NO: 235640 - DNA, 25 bp, Artificial sequence
  SiRNA target sequence
gtcattagtcgtattattttatgct

SEQ ID NO: 235641 - DNA, 25 bp, Artificial sequence
  SiRNA target sequence
tcattagtcgtattattttatgctg

SEQ ID NO: 235642 - DNA, 25 bp, Artificial sequence
  SiRNA target sequence
cattagtcgtattattttatgctgt

SEQ ID NO: 235643 - DNA, 25 bp, Artificial sequence
  SiRNA target sequence
attagtcgtattattttatgctgtt

SEQ ID NO: 235644 - DNA, 25 bp, Artificial sequence
  SiRNA target sequence
ttagtcgtattattttatgctgttt

SEQ ID NO: 235645 - DNA, 25 bp, Artificial sequence
  SiRNA target sequence
tagtcgtattattttatgctgtttc

SEQ ID NO: 235646 - DNA, 25 bp, Artificial sequence
  SiRNA target sequence
agtcgtattattttatgctgtttct

SEQ ID NO: 235647 - DNA, 25 bp, Artificial sequence
  SiRNA target sequence
gtcgtattattttatgctgtttcta

SEQ ID NO: 235648 - DNA, 25 bp, Artificial sequence
  SiRNA target sequence
tcgtattattttatgctgtttctac

SEQ ID NO: 235649 - DNA, 25 bp, Artificial sequence
  SiRNA target sequence
cgtattattttatgctgtttctacg

SEQ ID NO: 235650 - DNA, 25 bp, Artificial sequence
  SiRNA target sequence
gtattattttatgctgtttctacga

SEQ ID NO: 235651 - DNA, 25 bp, Artificial sequence
  SiRNA target sequence
tattattttatgctgtttctacgaa

SEQ ID NO: 235652 - DNA, 25 bp, Artificial sequence
  SiRNA target sequence
attattttatgctgtttctacgaat

SEQ ID NO: 235653 - DNA, 25 bp, Artificial sequence
  SiRNA target sequence
ttattttatgctgtttctacgaata

SEQ ID NO: 235654 - DNA, 25 bp, Artificial sequence
  SiRNA target sequence
tattttatgctgtttctacgaatat

SEQ ID NO: 235655 - DNA, 25 bp, Artificial sequence
  SiRNA target sequence
attttatgctgtttctacgaatatt

SEQ ID NO: 235656 - DNA, 25 bp, Artificial sequence
  SiRNA target sequence
ttttatgctgtttctacgaatatta

SEQ ID NO: 235657 - DNA, 25 bp, Artificial sequence
  SiRNA target sequence
tttatgctgtttctacgaatattat

SEQ ID NO: 235658 - DNA, 25 bp, Artificial sequence
  SiRNA target sequence
ttatgctgtttctacgaatattatt

SEQ ID NO: 235659 - DNA, 25 bp, Artificial sequence
  SiRNA target sequence
tatgctgtttctacgaatattattg

SEQ ID NO: 235660 - DNA, 25 bp, Artificial sequence
  SiRNA target sequence
atgctgtttctacgaatattattga

SEQ ID NO: 235661 - DNA, 25 bp, Artificial sequence
  SiRNA target sequence
tgctgtttctacgaatattattgag

SEQ ID NO: 235662 - DNA, 25 bp, Artificial sequence
  SiRNA target sequence
gctgtttctacgaatattattgagt

SEQ ID NO: 235663 - DNA, 25 bp, Artificial sequence
  SiRNA target sequence
ctgtttctacgaatattattgagtc

SEQ ID NO: 235664 - DNA, 25 bp, Artificial sequence
  SiRNA target sequence
tgtttctacgaatattattgagtca

SEQ ID NO: 235665 - DNA, 25 bp, Artificial sequence
  SiRNA target sequence
gtttctacgaatattattgagtcag

SEQ ID NO: 235666 - DNA, 25 bp, Artificial sequence
  SiRNA target sequence
tttctacgaatattattgagtcagc

SEQ ID NO: 235667 - DNA, 25 bp, Artificial sequence
  SiRNA target sequence
ttctacgaatattattgagtcagct

SEQ ID NO: 235668 - DNA, 25 bp, Artificial sequence
  SiRNA target sequence
tctacgaatattattgagtcagctt

SEQ ID NO: 235669 - DNA, 25 bp, Artificial sequence
  SiRNA target sequence
ctacgaatattattgagtcagctta

SEQ ID NO: 235670 - DNA, 25 bp, Artificial sequence
  SiRNA target sequence
tacgaatattattgagtcagcttat

SEQ ID NO: 235671 - DNA, 25 bp, Artificial sequence
  SiRNA target sequence
acgaatattattgagtcagcttata

SEQ ID NO: 235672 - DNA, 25 bp, Artificial sequence
  SiRNA target sequence
cgaatattattgagtcagcttataa

SEQ ID NO: 235673 - DNA, 25 bp, Artificial sequence
  SiRNA target sequence
gaatattattgagtcagcttataaa

SEQ ID NO: 235674 - DNA, 25 bp, Artificial sequence
  SiRNA target sequence
aatattattgagtcagcttataaat

SEQ ID NO: 235675 - DNA, 25 bp, Artificial sequence
  SiRNA target sequence
atattattgagtcagcttataaatc

SEQ ID NO: 235676 - DNA, 25 bp, Artificial sequence
  SiRNA target sequence
tattattgagtcagcttataaatct

SEQ ID NO: 235677 - DNA, 25 bp, Artificial sequence
  SiRNA target sequence
attattgagtcagcttataaatctg

SEQ ID NO: 235678 - DNA, 25 bp, Artificial sequence
  SiRNA target sequence
ttattgagtcagcttataaatctgc

SEQ ID NO: 235679 - DNA, 25 bp, Artificial sequence
  SiRNA target sequence
tattgagtcagcttataaatctgct

SEQ ID NO: 235680 - DNA, 25 bp, Artificial sequence
  SiRNA target sequence
attgagtcagcttataaatctgctt

SEQ ID NO: 235681 - DNA, 25 bp, Artificial sequence
  SiRNA target sequence
ttgagtcagcttataaatctgcttt

SEQ ID NO: 235682 - DNA, 25 bp, Artificial sequence
  SiRNA target sequence
tgagtcagcttataaatctgcttta

SEQ ID NO: 235683 - DNA, 25 bp, Artificial sequence
  SiRNA target sequence
gagtcagcttataaatctgctttag

SEQ ID NO: 235684 - DNA, 25 bp, Artificial sequence
  SiRNA target sequence
agtcagcttataaatctgctttagc

SEQ ID NO: 235685 - DNA, 25 bp, Artificial sequence
  SiRNA target sequence
gtcagcttataaatctgctttagct

SEQ ID NO: 235686 - DNA, 25 bp, Artificial sequence
  SiRNA target sequence
tcagcttataaatctgctttagctg

SEQ ID NO: 235687 - DNA, 25 bp, Artificial sequence
  SiRNA target sequence
cagcttataaatctgctttagctgt

SEQ ID NO: 235688 - DNA, 25 bp, Artificial sequence
  SiRNA target sequence
agcttataaatctgctttagctgtc

SEQ ID NO: 235689 - DNA, 25 bp, Artificial sequence
  SiRNA target sequence
gcttataaatctgctttagctgtcg

SEQ ID NO: 235690 - DNA, 25 bp, Artificial sequence
  SiRNA target sequence
cttataaatctgctttagctgtcgg

SEQ ID NO: 235691 - DNA, 25 bp, Artificial sequence
  SiRNA target sequence
ttataaatctgctttagctgtcggt

SEQ ID NO: 235692 - DNA, 25 bp, Artificial sequence
  SiRNA target sequence
tataaatctgctttagctgtcggtg

SEQ ID NO: 235693 - DNA, 25 bp, Artificial sequence
  SiRNA target sequence
ataaatctgctttagctgtcggtgc

SEQ ID NO: 235694 - DNA, 25 bp, Artificial sequence
  SiRNA target sequence
taaatctgctttagctgtcggtgct

SEQ ID NO: 235695 - DNA, 25 bp, Artificial sequence
  SiRNA target sequence
aaatctgctttagctgtcggtgcta

SEQ ID NO: 235696 - DNA, 25 bp, Artificial sequence
  SiRNA target sequence
aatctgctttagctgtcggtgctaa

SEQ ID NO: 235697 - DNA, 25 bp, Artificial sequence
  SiRNA target sequence
atctgctttagctgtcggtgctaat

SEQ ID NO: 235698 - DNA, 25 bp, Artificial sequence
  SiRNA target sequence
tctgctttagctgtcggtgctaatg

SEQ ID NO: 235699 - DNA, 25 bp, Artificial sequence
  SiRNA target sequence
ctgctttagctgtcggtgctaatga

SEQ ID NO: 235700 - DNA, 25 bp, Artificial sequence
  SiRNA target sequence
tgctttagctgtcggtgctaatgaa

SEQ ID NO: 235701 - DNA, 25 bp, Artificial sequence
  SiRNA target sequence
gctttagctgtcggtgctaatgaaa

SEQ ID NO: 235702 - DNA, 25 bp, Artificial sequence
  SiRNA target sequence
ctttagctgtcggtgctaatgaaac

SEQ ID NO: 235703 - DNA, 25 bp, Artificial sequence
  SiRNA target sequence
tttagctgtcggtgctaatgaaact

SEQ ID NO: 235704 - DNA, 25 bp, Artificial sequence
  SiRNA target sequence
ttagctgtcggtgctaatgaaactg

SEQ ID NO: 235705 - DNA, 25 bp, Artificial sequence
  SiRNA target sequence
tagctgtcggtgctaatgaaactgg

SEQ ID NO: 235706 - DNA, 25 bp, Artificial sequence
  SiRNA target sequence
agctgtcggtgctaatgaaactggt

SEQ ID NO: 235707 - DNA, 25 bp, Artificial sequence
  SiRNA target sequence
gctgtcggtgctaatgaaactggtg

SEQ ID NO: 235708 - DNA, 25 bp, Artificial sequence
  SiRNA target sequence
ctgtcggtgctaatgaaactggtga

SEQ ID NO: 235709 - DNA, 25 bp, Artificial sequence
  SiRNA target sequence
tgtcggtgctaatgaaactggtgag

SEQ ID NO: 235710 - DNA, 25 bp, Artificial sequence
  SiRNA target sequence
gtcggtgctaatgaaactggtgagg

SEQ ID NO: 235711 - DNA, 25 bp, Artificial sequence
  SiRNA target sequence
tcggtgctaatgaaactggtgaggc

SEQ ID NO: 235712 - DNA, 25 bp, Artificial sequence
  SiRNA target sequence
cggtgctaatgaaactggtgaggca

SEQ ID NO: 235713 - DNA, 25 bp, Artificial sequence
  SiRNA target sequence
ggtgctaatgaaactggtgaggcaa

SEQ ID NO: 235714 - DNA, 25 bp, Artificial sequence
  SiRNA target sequence
gtgctaatgaaactggtgaggcaaa

SEQ ID NO: 235715 - DNA, 25 bp, Artificial sequence
  SiRNA target sequence
tgctaatgaaactggtgaggcaaaa

SEQ ID NO: 235716 - DNA, 25 bp, Artificial sequence
  SiRNA target sequence
gctaatgaaactggtgaggcaaaat

SEQ ID NO: 235717 - DNA, 25 bp, Artificial sequence
  SiRNA target sequence
ctaatgaaactggtgaggcaaaatc

SEQ ID NO: 235718 - DNA, 25 bp, Artificial sequence
  SiRNA target sequence
taatgaaactggtgaggcaaaatct

SEQ ID NO: 235719 - DNA, 25 bp, Artificial sequence
  SiRNA target sequence
aatgaaactggtgaggcaaaatcta

SEQ ID NO: 235720 - DNA, 25 bp, Artificial sequence
  SiRNA target sequence
atgaaactggtgaggcaaaatctac

SEQ ID NO: 235721 - DNA, 25 bp, Artificial sequence
  SiRNA target sequence
tgaaactggtgaggcaaaatctacc

SEQ ID NO: 235722 - DNA, 25 bp, Artificial sequence
  SiRNA target sequence
gaaactggtgaggcaaaatctacct

SEQ ID NO: 235723 - DNA, 25 bp, Artificial sequence
  SiRNA target sequence
aaactggtgaggcaaaatctaccta

SEQ ID NO: 235724 - DNA, 25 bp, Artificial sequence
  SiRNA target sequence
aactggtgaggcaaaatctacctat

SEQ ID NO: 235725 - DNA, 25 bp, Artificial sequence
  SiRNA target sequence
actggtgaggcaaaatctacctatg

SEQ ID NO: 235726 - DNA, 25 bp, Artificial sequence
  SiRNA target sequence
ctggtgaggcaaaatctacctatgc

SEQ ID NO: 235727 - DNA, 25 bp, Artificial sequence
  SiRNA target sequence
tggtgaggcaaaatctacctatgct

SEQ ID NO: 235728 - DNA, 25 bp, Artificial sequence
  SiRNA target sequence
ggtgaggcaaaatctacctatgctt

SEQ ID NO: 235729 - DNA, 25 bp, Artificial sequence
  SiRNA target sequence
gtgaggcaaaatctacctatgcttc

SEQ ID NO: 235730 - DNA, 25 bp, Artificial sequence
  SiRNA target sequence
tgaggcaaaatctacctatgcttca

SEQ ID NO: 235731 - DNA, 25 bp, Artificial sequence
  SiRNA target sequence
gaggcaaaatctacctatgcttcaa

SEQ ID NO: 235732 - DNA, 25 bp, Artificial sequence
  SiRNA target sequence
aggcaaaatctacctatgcttcaat

SEQ ID NO: 235733 - DNA, 25 bp, Artificial sequence
  SiRNA target sequence
ggcaaaatctacctatgcttcaatt

SEQ ID NO: 235734 - DNA, 25 bp, Artificial sequence
  SiRNA target sequence
gcaaaatctacctatgcttcaattt

SEQ ID NO: 235735 - DNA, 25 bp, Artificial sequence
  SiRNA target sequence
caaaatctacctatgcttcaattta

SEQ ID NO: 235736 - DNA, 25 bp, Artificial sequence
  SiRNA target sequence
aaaatctacctatgcttcaatttat

SEQ ID NO: 235737 - DNA, 25 bp, Artificial sequence
  SiRNA target sequence
aaatctacctatgcttcaatttata

SEQ ID NO: 235738 - DNA, 25 bp, Artificial sequence
  SiRNA target sequence
aatctacctatgcttcaatttatac

SEQ ID NO: 235739 - DNA, 25 bp, Artificial sequence
  SiRNA target sequence
atctacctatgcttcaatttataca

SEQ ID NO: 235740 - DNA, 25 bp, Artificial sequence
  SiRNA target sequence
tctacctatgcttcaatttatacat

SEQ ID NO: 235741 - DNA, 25 bp, Artificial sequence
  SiRNA target sequence
ctacctatgcttcaatttatacatc

SEQ ID NO: 235742 - DNA, 25 bp, Artificial sequence
  SiRNA target sequence
tacctatgcttcaatttatacatca

SEQ ID NO: 235743 - DNA, 25 bp, Artificial sequence
  SiRNA target sequence
acctatgcttcaatttatacatcaa

SEQ ID NO: 235744 - DNA, 25 bp, Artificial sequence
  SiRNA target sequence
cctatgcttcaatttatacatcaat

SEQ ID NO: 235745 - DNA, 25 bp, Artificial sequence
  SiRNA target sequence
ctatgcttcaatttatacatcaatt

SEQ ID NO: 235746 - DNA, 25 bp, Artificial sequence
  SiRNA target sequence
tatgcttcaatttatacatcaattg

SEQ ID NO: 235747 - DNA, 25 bp, Artificial sequence
  SiRNA target sequence
atgcttcaatttatacatcaattga

SEQ ID NO: 235748 - DNA, 25 bp, Artificial sequence
  SiRNA target sequence
tgcttcaatttatacatcaattgaa

SEQ ID NO: 235749 - DNA, 25 bp, Artificial sequence
  SiRNA target sequence
gcttcaatttatacatcaattgaac

SEQ ID NO: 235750 - DNA, 25 bp, Artificial sequence
  SiRNA target sequence
cttcaatttatacatcaattgaaca

SEQ ID NO: 235751 - DNA, 25 bp, Artificial sequence
  SiRNA target sequence
ttcaatttatacatcaattgaacaa

SEQ ID NO: 235752 - DNA, 25 bp, Artificial sequence
  SiRNA target sequence
tcaatttatacatcaattgaacaat

SEQ ID NO: 235753 - DNA, 25 bp, Artificial sequence
  SiRNA target sequence
caatttatacatcaattgaacaatc

SEQ ID NO: 235754 - DNA, 25 bp, Artificial sequence
  SiRNA target sequence
aatttatacatcaattgaacaatct

SEQ ID NO: 235755 - DNA, 25 bp, Artificial sequence
  SiRNA target sequence
atttatacatcaattgaacaatctg

SEQ ID NO: 235756 - DNA, 25 bp, Artificial sequence
  SiRNA target sequence
tttatacatcaattgaacaatctgg

SEQ ID NO: 235757 - DNA, 25 bp, Artificial sequence
  SiRNA target sequence
ttatacatcaattgaacaatctgga

SEQ ID NO: 235758 - DNA, 25 bp, Artificial sequence
  SiRNA target sequence
tatacatcaattgaacaatctggag

SEQ ID NO: 235759 - DNA, 25 bp, Artificial sequence
  SiRNA target sequence
atacatcaattgaacaatctggagt

SEQ ID NO: 235760 - DNA, 25 bp, Artificial sequence
  SiRNA target sequence
tacatcaattgaacaatctggagtt

SEQ ID NO: 235761 - DNA, 25 bp, Artificial sequence
  SiRNA target sequence
acatcaattgaacaatctggagttg

SEQ ID NO: 235762 - DNA, 25 bp, Artificial sequence
  SiRNA target sequence
catcaattgaacaatctggagttgc

SEQ ID NO: 235763 - DNA, 25 bp, Artificial sequence
  SiRNA target sequence
atcaattgaacaatctggagttgct

SEQ ID NO: 235764 - DNA, 25 bp, Artificial sequence
  SiRNA target sequence
tcaattgaacaatctggagttgctg

SEQ ID NO: 235765 - DNA, 25 bp, Artificial sequence
  SiRNA target sequence
caattgaacaatctggagttgctgt

SEQ ID NO: 235766 - DNA, 25 bp, Artificial sequence
  SiRNA target sequence
aattgaacaatctggagttgctgtt

SEQ ID NO: 235767 - DNA, 25 bp, Artificial sequence
  SiRNA target sequence
attgaacaatctggagttgctgtta

SEQ ID NO: 235768 - DNA, 25 bp, Artificial sequence
  SiRNA target sequence
ttgaacaatctggagttgctgttat

SEQ ID NO: 235769 - DNA, 25 bp, Artificial sequence
  SiRNA target sequence
tgaacaatctggagttgctgttatt

SEQ ID NO: 235770 - DNA, 25 bp, Artificial sequence
  SiRNA target sequence
gaacaatctggagttgctgttattg

SEQ ID NO: 235771 - DNA, 25 bp, Artificial sequence
  SiRNA target sequence
aacaatctggagttgctgttattgt

SEQ ID NO: 235772 - DNA, 25 bp, Artificial sequence
  SiRNA target sequence
acaatctggagttgctgttattgtc

SEQ ID NO: 235773 - DNA, 25 bp, Artificial sequence
  SiRNA target sequence
caatctggagttgctgttattgtca

SEQ ID NO: 235774 - DNA, 25 bp, Artificial sequence
  SiRNA target sequence
aatctggagttgctgttattgtcat

SEQ ID NO: 235775 - DNA, 25 bp, Artificial sequence
  SiRNA target sequence
atctggagttgctgttattgtcatg

SEQ ID NO: 235776 - DNA, 25 bp, Artificial sequence
  SiRNA target sequence
tctggagttgctgttattgtcatga

SEQ ID NO: 235777 - DNA, 25 bp, Artificial sequence
  SiRNA target sequence
ctggagttgctgttattgtcatgat

SEQ ID NO: 235778 - DNA, 25 bp, Artificial sequence
  SiRNA target sequence
tggagttgctgttattgtcatgatt

SEQ ID NO: 235779 - DNA, 25 bp, Artificial sequence
  SiRNA target sequence
ggagttgctgttattgtcatgattt

SEQ ID NO: 235780 - DNA, 25 bp, Artificial sequence
  SiRNA target sequence
gagttgctgttattgtcatgatttt

SEQ ID NO: 235781 - DNA, 25 bp, Artificial sequence
  SiRNA target sequence
agttgctgttattgtcatgattttg

SEQ ID NO: 235782 - DNA, 25 bp, Artificial sequence
  SiRNA target sequence
gttgctgttattgtcatgattttgc

SEQ ID NO: 235783 - DNA, 25 bp, Artificial sequence
  SiRNA target sequence
ttgctgttattgtcatgattttgct

SEQ ID NO: 235784 - DNA, 25 bp, Artificial sequence
  SiRNA target sequence
tgctgttattgtcatgattttgcta

SEQ ID NO: 235785 - DNA, 25 bp, Artificial sequence
  SiRNA target sequence
gctgttattgtcatgattttgctac

SEQ ID NO: 235786 - DNA, 25 bp, Artificial sequence
  SiRNA target sequence
ctgttattgtcatgattttgctact

SEQ ID NO: 235787 - DNA, 25 bp, Artificial sequence
  SiRNA target sequence
tgttattgtcatgattttgctactt

SEQ ID NO: 235788 - DNA, 25 bp, Artificial sequence
  SiRNA target sequence
gttattgtcatgattttgctactta

SEQ ID NO: 235789 - DNA, 25 bp, Artificial sequence
  SiRNA target sequence
ttattgtcatgattttgctacttac

SEQ ID NO: 235790 - DNA, 25 bp, Artificial sequence
  SiRNA target sequence
tattgtcatgattttgctacttacc

SEQ ID NO: 235791 - DNA, 25 bp, Artificial sequence
  SiRNA target sequence
attgtcatgattttgctacttaccc

SEQ ID NO: 235792 - DNA, 25 bp, Artificial sequence
  SiRNA target sequence
ttgtcatgattttgctacttacccc

SEQ ID NO: 235793 - DNA, 25 bp, Artificial sequence
  SiRNA target sequence
tgtcatgattttgctacttacccct

SEQ ID NO: 235794 - DNA, 25 bp, Artificial sequence
  SiRNA target sequence
gtcatgattttgctacttacccctt

SEQ ID NO: 235795 - DNA, 25 bp, Artificial sequence
  SiRNA target sequence
tcatgattttgctacttaccccttt

SEQ ID NO: 235796 - DNA, 25 bp, Artificial sequence
  SiRNA target sequence
catgattttgctacttacccctttt

SEQ ID NO: 235797 - DNA, 25 bp, Artificial sequence
  SiRNA target sequence
atgattttgctacttaccccttttc

SEQ ID NO: 235798 - DNA, 25 bp, Artificial sequence
  SiRNA target sequence
tgattttgctacttaccccttttcc

SEQ ID NO: 235799 - DNA, 25 bp, Artificial sequence
  SiRNA target sequence
gattttgctacttaccccttttcca

SEQ ID NO: 235800 - DNA, 25 bp, Artificial sequence
  SiRNA target sequence
attttgctacttaccccttttccaa

SEQ ID NO: 235801 - DNA, 25 bp, Artificial sequence
  SiRNA target sequence
ttttgctacttaccccttttccaag

SEQ ID NO: 235802 - DNA, 25 bp, Artificial sequence
  SiRNA target sequence
tttgctacttaccccttttccaagg

SEQ ID NO: 235803 - DNA, 25 bp, Artificial sequence
  SiRNA target sequence
ttgctacttaccccttttccaaggc

SEQ ID NO: 235804 - DNA, 25 bp, Artificial sequence
  SiRNA target sequence
tgctacttaccccttttccaaggct

SEQ ID NO: 235805 - DNA, 25 bp, Artificial sequence
  SiRNA target sequence
gctacttaccccttttccaaggctt

SEQ ID NO: 235806 - DNA, 25 bp, Artificial sequence
  SiRNA target sequence
ctacttaccccttttccaaggctta

SEQ ID NO: 235807 - DNA, 25 bp, Artificial sequence
  SiRNA target sequence
tacttaccccttttccaaggcttat

SEQ ID NO: 235808 - DNA, 25 bp, Artificial sequence
  SiRNA target sequence
acttaccccttttccaaggcttatt

SEQ ID NO: 235809 - DNA, 25 bp, Artificial sequence
  SiRNA target sequence
cttaccccttttccaaggcttatta

SEQ ID NO: 235810 - DNA, 25 bp, Artificial sequence
  SiRNA target sequence
ttaccccttttccaaggcttattaa

SEQ ID NO: 235811 - DNA, 25 bp, Artificial sequence
  SiRNA target sequence
taccccttttccaaggcttattaaa

SEQ ID NO: 235812 - DNA, 25 bp, Artificial sequence
  SiRNA target sequence
accccttttccaaggcttattaaaa

SEQ ID NO: 235813 - DNA, 25 bp, Artificial sequence
  SiRNA target sequence
ccccttttccaaggcttattaaaac

SEQ ID NO: 235814 - DNA, 25 bp, Artificial sequence
  SiRNA target sequence
cccttttccaaggcttattaaaaca

SEQ ID NO: 235815 - DNA, 25 bp, Artificial sequence
  SiRNA target sequence
ccttttccaaggcttattaaaacaa

SEQ ID NO: 235816 - DNA, 25 bp, Artificial sequence
  SiRNA target sequence
cttttccaaggcttattaaaacaaa

SEQ ID NO: 235817 - DNA, 25 bp, Artificial sequence
  SiRNA target sequence
ttttccaaggcttattaaaacaaaa

SEQ ID NO: 235818 - DNA, 25 bp, Artificial sequence
  SiRNA target sequence
tttccaaggcttattaaaacaaaag

SEQ ID NO: 235819 - DNA, 25 bp, Artificial sequence
  SiRNA target sequence
ttccaaggcttattaaaacaaaagg

SEQ ID NO: 235820 - DNA, 25 bp, Artificial sequence
  SiRNA target sequence
tccaaggcttattaaaacaaaagga

SEQ ID NO: 235821 - DNA, 25 bp, Artificial sequence
  SiRNA target sequence
ccaaggcttattaaaacaaaaggat

SEQ ID NO: 235822 - DNA, 25 bp, Artificial sequence
  SiRNA target sequence
caaggcttattaaaacaaaaggatg

SEQ ID NO: 235823 - DNA, 25 bp, Artificial sequence
  SiRNA target sequence
aaggcttattaaaacaaaaggatgg

SEQ ID NO: 235824 - DNA, 25 bp, Artificial sequence
  SiRNA target sequence
aggcttattaaaacaaaaggatgga

SEQ ID NO: 235825 - DNA, 25 bp, Artificial sequence
  SiRNA target sequence
ggcttattaaaacaaaaggatggat

SEQ ID NO: 235826 - DNA, 25 bp, Artificial sequence
  SiRNA target sequence
gcttattaaaacaaaaggatggatt

SEQ ID NO: 235827 - DNA, 25 bp, Artificial sequence
  SiRNA target sequence
cttattaaaacaaaaggatggatta

SEQ ID NO: 235828 - DNA, 25 bp, Artificial sequence
  SiRNA target sequence
ttattaaaacaaaaggatggattac

SEQ ID NO: 235829 - DNA, 25 bp, Artificial sequence
  SiRNA target sequence
tattaaaacaaaaggatggattaca

SEQ ID NO: 235830 - DNA, 25 bp, Artificial sequence
  SiRNA target sequence
attaaaacaaaaggatggattacaa

SEQ ID NO: 235831 - DNA, 25 bp, Artificial sequence
  SiRNA target sequence
ttaaaacaaaaggatggattacaat

SEQ ID NO: 235832 - DNA, 25 bp, Artificial sequence
  SiRNA target sequence
taaaacaaaaggatggattacaata

SEQ ID NO: 235833 - DNA, 25 bp, Artificial sequence
  SiRNA target sequence
aaaacaaaaggatggattacaatag

SEQ ID NO: 235834 - DNA, 25 bp, Artificial sequence
  SiRNA target sequence
aaacaaaaggatggattacaatagc

SEQ ID NO: 235835 - DNA, 25 bp, Artificial sequence
  SiRNA target sequence
aacaaaaggatggattacaatagcc

SEQ ID NO: 235836 - DNA, 25 bp, Artificial sequence
  SiRNA target sequence
acaaaaggatggattacaatagcca

SEQ ID NO: 235837 - DNA, 25 bp, Artificial sequence
  SiRNA target sequence
caaaaggatggattacaatagccat

SEQ ID NO: 235838 - DNA, 25 bp, Artificial sequence
  SiRNA target sequence
aaaaggatggattacaatagccatt

SEQ ID NO: 235839 - DNA, 25 bp, Artificial sequence
  SiRNA target sequence
aaaggatggattacaatagccattc

SEQ ID NO: 235840 - DNA, 25 bp, Artificial sequence
  SiRNA target sequence
aaggatggattacaatagccattct

SEQ ID NO: 235841 - DNA, 25 bp, Artificial sequence
  SiRNA target sequence
aggatggattacaatagccattcta

SEQ ID NO: 235842 - DNA, 25 bp, Artificial sequence
  SiRNA target sequence
ggatggattacaatagccattctat

SEQ ID NO: 235843 - DNA, 25 bp, Artificial sequence
  SiRNA target sequence
gatggattacaatagccattctatg

SEQ ID NO: 235844 - DNA, 25 bp, Artificial sequence
  SiRNA target sequence
atggattacaatagccattctatgt

SEQ ID NO: 235845 - DNA, 25 bp, Artificial sequence
  SiRNA target sequence
tggattacaatagccattctatgtc

SEQ ID NO: 235846 - DNA, 25 bp, Artificial sequence
  SiRNA target sequence
ggattacaatagccattctatgtcc

SEQ ID NO: 235847 - DNA, 25 bp, Artificial sequence
  SiRNA target sequence
gattacaatagccattctatgtcct

SEQ ID NO: 235848 - DNA, 25 bp, Artificial sequence
  SiRNA target sequence
attacaatagccattctatgtccta

SEQ ID NO: 235849 - DNA, 25 bp, Artificial sequence
  SiRNA target sequence
ttacaatagccattctatgtcctat

SEQ ID NO: 235850 - DNA, 25 bp, Artificial sequence
  SiRNA target sequence
tacaatagccattctatgtcctatt

SEQ ID NO: 235851 - DNA, 25 bp, Artificial sequence
  SiRNA target sequence
acaatagccattctatgtcctatta

SEQ ID NO: 235852 - DNA, 25 bp, Artificial sequence
  SiRNA target sequence
caatagccattctatgtcctattat

SEQ ID NO: 235853 - DNA, 25 bp, Artificial sequence
  SiRNA target sequence
aatagccattctatgtcctattatt

SEQ ID NO: 235854 - DNA, 25 bp, Artificial sequence
  SiRNA target sequence
atagccattctatgtcctattatta

SEQ ID NO: 235855 - DNA, 25 bp, Artificial sequence
  SiRNA target sequence
tagccattctatgtcctattattac

SEQ ID NO: 235856 - DNA, 25 bp, Artificial sequence
  SiRNA target sequence
agccattctatgtcctattattact

SEQ ID NO: 235857 - DNA, 25 bp, Artificial sequence
  SiRNA target sequence
gccattctatgtcctattattactt

SEQ ID NO: 235858 - DNA, 25 bp, Artificial sequence
  SiRNA target sequence
ccattctatgtcctattattacttt

SEQ ID NO: 235859 - DNA, 25 bp, Artificial sequence
  SiRNA target sequence
cattctatgtcctattattactttt

SEQ ID NO: 235860 - DNA, 25 bp, Artificial sequence
  SiRNA target sequence
attctatgtcctattattacttttt

SEQ ID NO: 235861 - DNA, 25 bp, Artificial sequence
  SiRNA target sequence
ttctatgtcctattattactttttt

SEQ ID NO: 235862 - DNA, 25 bp, Artificial sequence
  SiRNA target sequence
tctatgtcctattattacttttttt

SEQ ID NO: 235863 - DNA, 25 bp, Artificial sequence
  SiRNA target sequence
ctatgtcctattattactttttttt

SEQ ID NO: 235864 - DNA, 25 bp, Artificial sequence
  SiRNA target sequence
tatgtcctattattacttttttttc

SEQ ID NO: 235865 - DNA, 25 bp, Artificial sequence
  SiRNA target sequence
atgtcctattattacttttttttct

SEQ ID NO: 235866 - DNA, 25 bp, Artificial sequence
  SiRNA target sequence
tgtcctattattacttttttttctg

SEQ ID NO: 235867 - DNA, 25 bp, Artificial sequence
  SiRNA target sequence
gtcctattattacttttttttctgc

SEQ ID NO: 235868 - DNA, 25 bp, Artificial sequence
  SiRNA target sequence
tcctattattacttttttttctgct

SEQ ID NO: 235869 - DNA, 25 bp, Artificial sequence
  SiRNA target sequence
cctattattacttttttttctgctt

SEQ ID NO: 235870 - DNA, 25 bp, Artificial sequence
  SiRNA target sequence
ctattattacttttttttctgcttt

SEQ ID NO: 235871 - DNA, 25 bp, Artificial sequence
  SiRNA target sequence
tattattacttttttttctgctttt

SEQ ID NO: 235872 - DNA, 25 bp, Artificial sequence
  SiRNA target sequence
attattacttttttttctgcttttg

SEQ ID NO: 235873 - DNA, 25 bp, Artificial sequence
  SiRNA target sequence
ttattacttttttttctgcttttgg

SEQ ID NO: 235874 - DNA, 25 bp, Artificial sequence
  SiRNA target sequence
tattacttttttttctgcttttggt

SEQ ID NO: 235875 - DNA, 25 bp, Artificial sequence
  SiRNA target sequence
attacttttttttctgcttttggta

SEQ ID NO: 235876 - DNA, 25 bp, Artificial sequence
  SiRNA target sequence
ttacttttttttctgcttttggtac

SEQ ID NO: 235877 - DNA, 25 bp, Artificial sequence
  SiRNA target sequence
tacttttttttctgcttttggtact

SEQ ID NO: 235878 - DNA, 25 bp, Artificial sequence
  SiRNA target sequence
acttttttttctgcttttggtactt

SEQ ID NO: 235879 - DNA, 25 bp, Artificial sequence
  SiRNA target sequence
cttttttttctgcttttggtacttt

SEQ ID NO: 235880 - DNA, 25 bp, Artificial sequence
  SiRNA target sequence
ttttttttctgcttttggtactttt

SEQ ID NO: 235881 - DNA, 25 bp, Artificial sequence
  SiRNA target sequence
tttttttctgcttttggtacttttg

SEQ ID NO: 235882 - DNA, 25 bp, Artificial sequence
  SiRNA target sequence
ttttttctgcttttggtacttttgt

SEQ ID NO: 235883 - DNA, 25 bp, Artificial sequence
  SiRNA target sequence
tttttctgcttttggtacttttgta

SEQ ID NO: 235884 - DNA, 25 bp, Artificial sequence
  SiRNA target sequence
ttttctgcttttggtacttttgtat

SEQ ID NO: 235885 - DNA, 25 bp, Artificial sequence
  SiRNA target sequence
tttctgcttttggtacttttgtatt

SEQ ID NO: 235886 - DNA, 25 bp, Artificial sequence
  SiRNA target sequence
ttctgcttttggtacttttgtatta

SEQ ID NO: 235887 - DNA, 25 bp, Artificial sequence
  SiRNA target sequence
tctgcttttggtacttttgtattag

SEQ ID NO: 235888 - DNA, 25 bp, Artificial sequence
  SiRNA target sequence
ctgcttttggtacttttgtattagc

SEQ ID NO: 235889 - DNA, 25 bp, Artificial sequence
  SiRNA target sequence
tgcttttggtacttttgtattagct

SEQ ID NO: 235890 - DNA, 25 bp, Artificial sequence
  SiRNA target sequence
gcttttggtacttttgtattagctt

SEQ ID NO: 235891 - DNA, 25 bp, Artificial sequence
  SiRNA target sequence
cttttggtacttttgtattagctta

SEQ ID NO: 235892 - DNA, 25 bp, Artificial sequence
  SiRNA target sequence
ttttggtacttttgtattagcttat

SEQ ID NO: 235893 - DNA, 25 bp, Artificial sequence
  SiRNA target sequence
tttggtacttttgtattagcttatt

SEQ ID NO: 235894 - DNA, 25 bp, Artificial sequence
  SiRNA target sequence
ttggtacttttgtattagcttattt

SEQ ID NO: 235895 - DNA, 25 bp, Artificial sequence
  SiRNA target sequence
tggtacttttgtattagcttattta

SEQ ID NO: 235896 - DNA, 25 bp, Artificial sequence
  SiRNA target sequence
ggtacttttgtattagcttatttaa

SEQ ID NO: 235897 - DNA, 25 bp, Artificial sequence
  SiRNA target sequence
gtacttttgtattagcttatttaaa

SEQ ID NO: 235898 - DNA, 25 bp, Artificial sequence
  SiRNA target sequence
tacttttgtattagcttatttaaac

SEQ ID NO: 235899 - DNA, 25 bp, Artificial sequence
  SiRNA target sequence
acttttgtattagcttatttaaact

SEQ ID NO: 235900 - DNA, 25 bp, Artificial sequence
  SiRNA target sequence
cttttgtattagcttatttaaactt

SEQ ID NO: 235901 - DNA, 25 bp, Artificial sequence
  SiRNA target sequence
ttttgtattagcttatttaaacttc

SEQ ID NO: 235902 - DNA, 25 bp, Artificial sequence
  SiRNA target sequence
tttgtattagcttatttaaacttcc

SEQ ID NO: 235903 - DNA, 25 bp, Artificial sequence
  SiRNA target sequence
ttgtattagcttatttaaacttccc

SEQ ID NO: 235904 - DNA, 25 bp, Artificial sequence
  SiRNA target sequence
tgtattagcttatttaaacttccca

SEQ ID NO: 235905 - DNA, 25 bp, Artificial sequence
  SiRNA target sequence
gtattagcttatttaaacttcccaa

SEQ ID NO: 235906 - DNA, 25 bp, Artificial sequence
  SiRNA target sequence
tattagcttatttaaacttcccaat

SEQ ID NO: 235907 - DNA, 25 bp, Artificial sequence
  SiRNA target sequence
attagcttatttaaacttcccaatt

SEQ ID NO: 235908 - DNA, 25 bp, Artificial sequence
  SiRNA target sequence
ttagcttatttaaacttcccaatta

SEQ ID NO: 235909 - DNA, 25 bp, Artificial sequence
  SiRNA target sequence
tagcttatttaaacttcccaattac

SEQ ID NO: 235910 - DNA, 25 bp, Artificial sequence
  SiRNA target sequence
agcttatttaaacttcccaattaca

SEQ ID NO: 235911 - DNA, 25 bp, Artificial sequence
  SiRNA target sequence
gcttatttaaacttcccaattacaa

SEQ ID NO: 235912 - DNA, 25 bp, Artificial sequence
  SiRNA target sequence
cttatttaaacttcccaattacaaa

SEQ ID NO: 235913 - DNA, 25 bp, Artificial sequence
  SiRNA target sequence
ttatttaaacttcccaattacaaac

SEQ ID NO: 235914 - DNA, 25 bp, Artificial sequence
  SiRNA target sequence
tatttaaacttcccaattacaaaca

SEQ ID NO: 235915 - DNA, 25 bp, Artificial sequence
  SiRNA target sequence
atttaaacttcccaattacaaacaa

SEQ ID NO: 235916 - DNA, 25 bp, Artificial sequence
  SiRNA target sequence
tttaaacttcccaattacaaacaaa

SEQ ID NO: 235917 - DNA, 25 bp, Artificial sequence
  SiRNA target sequence
ttaaacttcccaattacaaacaaag

SEQ ID NO: 235918 - DNA, 25 bp, Artificial sequence
  SiRNA target sequence
taaacttcccaattacaaacaaaga

SEQ ID NO: 235919 - DNA, 25 bp, Artificial sequence
  SiRNA target sequence
aaacttcccaattacaaacaaagag

SEQ ID NO: 235920 - DNA, 25 bp, Artificial sequence
  SiRNA target sequence
aacttcccaattacaaacaaagagg

SEQ ID NO: 235921 - DNA, 25 bp, Artificial sequence
  SiRNA target sequence
acttcccaattacaaacaaagagga

SEQ ID NO: 235922 - DNA, 25 bp, Artificial sequence
  SiRNA target sequence
cttcccaattacaaacaaagaggat

SEQ ID NO: 235923 - DNA, 25 bp, Artificial sequence
  SiRNA target sequence
ttcccaattacaaacaaagaggata

SEQ ID NO: 235924 - DNA, 25 bp, Artificial sequence
  SiRNA target sequence
tcccaattacaaacaaagaggataa

SEQ ID NO: 235925 - DNA, 25 bp, Artificial sequence
  SiRNA target sequence
cccaattacaaacaaagaggataat

SEQ ID NO: 235926 - DNA, 25 bp, Artificial sequence
  SiRNA target sequence
ccaattacaaacaaagaggataata

SEQ ID NO: 235927 - DNA, 25 bp, Artificial sequence
  SiRNA target sequence
caattacaaacaaagaggataatat

SEQ ID NO: 235928 - DNA, 25 bp, Artificial sequence
  SiRNA target sequence
aattacaaacaaagaggataatata

SEQ ID NO: 235929 - DNA, 25 bp, Artificial sequence
  SiRNA target sequence
attacaaacaaagaggataatatat

SEQ ID NO: 235930 - DNA, 25 bp, Artificial sequence
  SiRNA target sequence
ttacaaacaaagaggataatatatt

SEQ ID NO: 235931 - DNA, 25 bp, Artificial sequence
  SiRNA target sequence
tacaaacaaagaggataatatattt

SEQ ID NO: 235932 - DNA, 25 bp, Artificial sequence
  SiRNA target sequence
acaaacaaagaggataatatatttg

SEQ ID NO: 235933 - DNA, 25 bp, Artificial sequence
  SiRNA target sequence
caaacaaagaggataatatatttga

SEQ ID NO: 235934 - DNA, 25 bp, Artificial sequence
  SiRNA target sequence
aaacaaagaggataatatatttgat

SEQ ID NO: 235935 - DNA, 25 bp, Artificial sequence
  SiRNA target sequence
aacaaagaggataatatatttgata

SEQ ID NO: 235936 - DNA, 25 bp, Artificial sequence
  SiRNA target sequence
acaaagaggataatatatttgatat

SEQ ID NO: 235937 - DNA, 25 bp, Artificial sequence
  SiRNA target sequence
caaagaggataatatatttgatatt

SEQ ID NO: 235938 - DNA, 25 bp, Artificial sequence
  SiRNA target sequence
aaagaggataatatatttgatattt

SEQ ID NO: 235939 - DNA, 25 bp, Artificial sequence
  SiRNA target sequence
aagaggataatatatttgatattta

SEQ ID NO: 235940 - DNA, 25 bp, Artificial sequence
  SiRNA target sequence
agaggataatatatttgatatttac

SEQ ID NO: 235941 - DNA, 25 bp, Artificial sequence
  SiRNA target sequence
gaggataatatatttgatatttacc

SEQ ID NO: 235942 - DNA, 25 bp, Artificial sequence
  SiRNA target sequence
aggataatatatttgatatttaccg

SEQ ID NO: 235943 - DNA, 25 bp, Artificial sequence
  SiRNA target sequence
ggataatatatttgatatttaccgt

SEQ ID NO: 235944 - DNA, 25 bp, Artificial sequence
  SiRNA target sequence
gataatatatttgatatttaccgtt

SEQ ID NO: 235945 - DNA, 25 bp, Artificial sequence
  SiRNA target sequence
ataatatatttgatatttaccgttt

SEQ ID NO: 235946 - DNA, 25 bp, Artificial sequence
  SiRNA target sequence
taatatatttgatatttaccgttta

SEQ ID NO: 235947 - DNA, 25 bp, Artificial sequence
  SiRNA target sequence
aatatatttgatatttaccgtttac

SEQ ID NO: 235948 - DNA, 25 bp, Artificial sequence
  SiRNA target sequence
atatatttgatatttaccgtttacc

SEQ ID NO: 235949 - DNA, 25 bp, Artificial sequence
  SiRNA target sequence
tatatttgatatttaccgtttaccg

SEQ ID NO: 235950 - DNA, 25 bp, Artificial sequence
  SiRNA target sequence
atatttgatatttaccgtttaccgt

SEQ ID NO: 235951 - DNA, 25 bp, Artificial sequence
  SiRNA target sequence
tatttgatatttaccgtttaccgtc

SEQ ID NO: 235952 - DNA, 25 bp, Artificial sequence
  SiRNA target sequence
atttgatatttaccgtttaccgtca

SEQ ID NO: 235953 - DNA, 25 bp, Artificial sequence
  SiRNA target sequence
tttgatatttaccgtttaccgtcaa

SEQ ID NO: 235954 - DNA, 25 bp, Artificial sequence
  SiRNA target sequence
ttgatatttaccgtttaccgtcaac

SEQ ID NO: 235955 - DNA, 25 bp, Artificial sequence
  SiRNA target sequence
tgatatttaccgtttaccgtcaact

SEQ ID NO: 235956 - DNA, 25 bp, Artificial sequence
  SiRNA target sequence
gatatttaccgtttaccgtcaactg

SEQ ID NO: 235957 - DNA, 25 bp, Artificial sequence
  SiRNA target sequence
atatttaccgtttaccgtcaactga

SEQ ID NO: 235958 - DNA, 25 bp, Artificial sequence
  SiRNA target sequence
tatttaccgtttaccgtcaactgat

SEQ ID NO: 235959 - DNA, 25 bp, Artificial sequence
  SiRNA target sequence
atttaccgtttaccgtcaactgatt

SEQ ID NO: 235960 - DNA, 25 bp, Artificial sequence
  SiRNA target sequence
tttaccgtttaccgtcaactgattc

SEQ ID NO: 235961 - DNA, 25 bp, Artificial sequence
  SiRNA target sequence
ttaccgtttaccgtcaactgattct

SEQ ID NO: 235962 - DNA, 25 bp, Artificial sequence
  SiRNA target sequence
taccgtttaccgtcaactgattcta

SEQ ID NO: 235963 - DNA, 25 bp, Artificial sequence
  SiRNA target sequence
accgtttaccgtcaactgattctat

SEQ ID NO: 235964 - DNA, 25 bp, Artificial sequence
  SiRNA target sequence
ccgtttaccgtcaactgattctata

SEQ ID NO: 235965 - DNA, 25 bp, Artificial sequence
  SiRNA target sequence
cgtttaccgtcaactgattctataa

SEQ ID NO: 235966 - DNA, 25 bp, Artificial sequence
  SiRNA target sequence
gtttaccgtcaactgattctataat

SEQ ID NO: 235967 - DNA, 25 bp, Artificial sequence
  SiRNA target sequence
tttaccgtcaactgattctataatc

SEQ ID NO: 235968 - DNA, 25 bp, Artificial sequence
  SiRNA target sequence
ttaccgtcaactgattctataatca

SEQ ID NO: 235969 - DNA, 25 bp, Artificial sequence
  SiRNA target sequence
taccgtcaactgattctataatcaa

SEQ ID NO: 235970 - DNA, 25 bp, Artificial sequence
  SiRNA target sequence
accgtcaactgattctataatcaaa

SEQ ID NO: 235971 - DNA, 25 bp, Artificial sequence
  SiRNA target sequence
ccgtcaactgattctataatcaaat

SEQ ID NO: 235972 - DNA, 25 bp, Artificial sequence
  SiRNA target sequence
cgtcaactgattctataatcaaatt

SEQ ID NO: 235973 - DNA, 25 bp, Artificial sequence
  SiRNA target sequence
gtcaactgattctataatcaaatta

SEQ ID NO: 235974 - DNA, 25 bp, Artificial sequence
  SiRNA target sequence
tcaactgattctataatcaaattag

SEQ ID NO: 235975 - DNA, 25 bp, Artificial sequence
  SiRNA target sequence
caactgattctataatcaaattaga

SEQ ID NO: 235976 - DNA, 25 bp, Artificial sequence
  SiRNA target sequence
aactgattctataatcaaattagaa

SEQ ID NO: 235977 - DNA, 25 bp, Artificial sequence
  SiRNA target sequence
actgattctataatcaaattagaaa

SEQ ID NO: 235978 - DNA, 25 bp, Artificial sequence
  SiRNA target sequence
ctgattctataatcaaattagaaaa

SEQ ID NO: 235979 - DNA, 25 bp, Artificial sequence
  SiRNA target sequence
tgattctataatcaaattagaaaat

SEQ ID NO: 235980 - DNA, 25 bp, Artificial sequence
  SiRNA target sequence
gattctataatcaaattagaaaata

SEQ ID NO: 235981 - DNA, 25 bp, Artificial sequence
  SiRNA target sequence
attctataatcaaattagaaaatat

SEQ ID NO: 235982 - DNA, 25 bp, Artificial sequence
  SiRNA target sequence
ttctataatcaaattagaaaatatt

SEQ ID NO: 235983 - DNA, 25 bp, Artificial sequence
  SiRNA target sequence
tctataatcaaattagaaaatattg

SEQ ID NO: 235984 - DNA, 25 bp, Artificial sequence
  SiRNA target sequence
ctataatcaaattagaaaatattgt

SEQ ID NO: 235985 - DNA, 25 bp, Artificial sequence
  SiRNA target sequence
tataatcaaattagaaaatattgtt

SEQ ID NO: 235986 - DNA, 25 bp, Artificial sequence
  SiRNA target sequence
ataatcaaattagaaaatattgttg

SEQ ID NO: 235987 - DNA, 25 bp, Artificial sequence
  SiRNA target sequence
taatcaaattagaaaatattgttgg

SEQ ID NO: 235988 - DNA, 25 bp, Artificial sequence
  SiRNA target sequence
aatcaaattagaaaatattgttggt

SEQ ID NO: 235989 - DNA, 25 bp, Artificial sequence
  SiRNA target sequence
atcaaattagaaaatattgttggtg

SEQ ID NO: 235990 - DNA, 25 bp, Artificial sequence
  SiRNA target sequence
tcaaattagaaaatattgttggtgt

SEQ ID NO: 235991 - DNA, 25 bp, Artificial sequence
  SiRNA target sequence
caaattagaaaatattgttggtgtc

SEQ ID NO: 235992 - DNA, 25 bp, Artificial sequence
  SiRNA target sequence
aaattagaaaatattgttggtgtca

SEQ ID NO: 235993 - DNA, 25 bp, Artificial sequence
  SiRNA target sequence
aattagaaaatattgttggtgtcat

SEQ ID NO: 235994 - DNA, 25 bp, Artificial sequence
  SiRNA target sequence
attagaaaatattgttggtgtcatt

SEQ ID NO: 235995 - DNA, 25 bp, Artificial sequence
  SiRNA target sequence
ttagaaaatattgttggtgtcattt

SEQ ID NO: 235996 - DNA, 25 bp, Artificial sequence
  SiRNA target sequence
tagaaaatattgttggtgtcatttg

SEQ ID NO: 235997 - DNA, 25 bp, Artificial sequence
  SiRNA target sequence
agaaaatattgttggtgtcatttgt

SEQ ID NO: 235998 - DNA, 25 bp, Artificial sequence
  SiRNA target sequence
gaaaatattgttggtgtcatttgtg

SEQ ID NO: 235999 - DNA, 25 bp, Artificial sequence
  SiRNA target sequence
aaaatattgttggtgtcatttgtgt

SEQ ID NO: 236000 - DNA, 25 bp, Artificial sequence
  SiRNA target sequence
aaatattgttggtgtcatttgtgta

SEQ ID NO: 236001 - DNA, 25 bp, Artificial sequence
  SiRNA target sequence
aatattgttggtgtcatttgtgtat

SEQ ID NO: 236002 - DNA, 25 bp, Artificial sequence
  SiRNA target sequence
atattgttggtgtcatttgtgtatc

SEQ ID NO: 236003 - DNA, 25 bp, Artificial sequence
  SiRNA target sequence
tattgttggtgtcatttgtgtatct

SEQ ID NO: 236004 - DNA, 25 bp, Artificial sequence
  SiRNA target sequence
attgttggtgtcatttgtgtatctt

SEQ ID NO: 236005 - DNA, 25 bp, Artificial sequence
  SiRNA target sequence
ttgttggtgtcatttgtgtatcttt

SEQ ID NO: 236006 - DNA, 25 bp, Artificial sequence
  SiRNA target sequence
tgttggtgtcatttgtgtatcttta

SEQ ID NO: 236007 - DNA, 25 bp, Artificial sequence
  SiRNA target sequence
gttggtgtcatttgtgtatctttaa

SEQ ID NO: 236008 - DNA, 25 bp, Artificial sequence
  SiRNA target sequence
ttggtgtcatttgtgtatctttaat

SEQ ID NO: 236009 - DNA, 25 bp, Artificial sequence
  SiRNA target sequence
tggtgtcatttgtgtatctttaatg

SEQ ID NO: 236010 - DNA, 25 bp, Artificial sequence
  SiRNA target sequence
ggtgtcatttgtgtatctttaatga

SEQ ID NO: 236011 - DNA, 25 bp, Artificial sequence
  SiRNA target sequence
gtgtcatttgtgtatctttaatgaa

SEQ ID NO: 236012 - DNA, 25 bp, Artificial sequence
  SiRNA target sequence
tgtcatttgtgtatctttaatgaag

SEQ ID NO: 236013 - DNA, 25 bp, Artificial sequence
  SiRNA target sequence
gtcatttgtgtatctttaatgaaga

SEQ ID NO: 236014 - DNA, 25 bp, Artificial sequence
  SiRNA target sequence
tcatttgtgtatctttaatgaagat

SEQ ID NO: 236015 - DNA, 25 bp, Artificial sequence
  SiRNA target sequence
catttgtgtatctttaatgaagatt

SEQ ID NO: 236016 - DNA, 25 bp, Artificial sequence
  SiRNA target sequence
atttgtgtatctttaatgaagattt

SEQ ID NO: 236017 - DNA, 25 bp, Artificial sequence
  SiRNA target sequence
tttgtgtatctttaatgaagatttc

SEQ ID NO: 236018 - DNA, 25 bp, Artificial sequence
  SiRNA target sequence
ttgtgtatctttaatgaagatttct

SEQ ID NO: 236019 - DNA, 25 bp, Artificial sequence
  SiRNA target sequence
tgtgtatctttaatgaagatttcta

SEQ ID NO: 236020 - DNA, 25 bp, Artificial sequence
  SiRNA target sequence
gtgtatctttaatgaagatttctaa

SEQ ID NO: 236021 - DNA, 25 bp, Artificial sequence
  SiRNA target sequence
tgtatctttaatgaagatttctaaa

SEQ ID NO: 236022 - DNA, 25 bp, Artificial sequence
  SiRNA target sequence
gtatctttaatgaagatttctaaat

SEQ ID NO: 236023 - DNA, 25 bp, Artificial sequence
  SiRNA target sequence
tatctttaatgaagatttctaaata

SEQ ID NO: 236024 - DNA, 25 bp, Artificial sequence
  SiRNA target sequence
atctttaatgaagatttctaaatat

SEQ ID NO: 236025 - DNA, 25 bp, Artificial sequence
  SiRNA target sequence
tctttaatgaagatttctaaatatg

SEQ ID NO: 236026 - DNA, 25 bp, Artificial sequence
  SiRNA target sequence
ctttaatgaagatttctaaatatgc

SEQ ID NO: 236027 - DNA, 25 bp, Artificial sequence
  SiRNA target sequence
tttaatgaagatttctaaatatgca

SEQ ID NO: 236028 - DNA, 25 bp, Artificial sequence
  SiRNA target sequence
ttaatgaagatttctaaatatgcag

SEQ ID NO: 236029 - DNA, 25 bp, Artificial sequence
  SiRNA target sequence
taatgaagatttctaaatatgcagc

SEQ ID NO: 236030 - DNA, 25 bp, Artificial sequence
  SiRNA target sequence
aatgaagatttctaaatatgcagca

SEQ ID NO: 236031 - DNA, 25 bp, Artificial sequence
  SiRNA target sequence
atgaagatttctaaatatgcagcat

SEQ ID NO: 236032 - DNA, 25 bp, Artificial sequence
  SiRNA target sequence
tgaagatttctaaatatgcagcatt

SEQ ID NO: 236033 - DNA, 25 bp, Artificial sequence
  SiRNA target sequence
gaagatttctaaatatgcagcattt

SEQ ID NO: 236034 - DNA, 25 bp, Artificial sequence
  SiRNA target sequence
aagatttctaaatatgcagcatttg

SEQ ID NO: 236035 - DNA, 25 bp, Artificial sequence
  SiRNA target sequence
agatttctaaatatgcagcatttga

SEQ ID NO: 236036 - DNA, 25 bp, Artificial sequence
  SiRNA target sequence
gatttctaaatatgcagcatttgat

SEQ ID NO: 236037 - DNA, 25 bp, Artificial sequence
  SiRNA target sequence
atttctaaatatgcagcatttgata

SEQ ID NO: 236038 - DNA, 25 bp, Artificial sequence
  SiRNA target sequence
tttctaaatatgcagcatttgatat

SEQ ID NO: 236039 - DNA, 25 bp, Artificial sequence
  SiRNA target sequence
ttctaaatatgcagcatttgatatc

SEQ ID NO: 236040 - DNA, 25 bp, Artificial sequence
  SiRNA target sequence
tctaaatatgcagcatttgatatca

SEQ ID NO: 236041 - DNA, 25 bp, Artificial sequence
  SiRNA target sequence
ctaaatatgcagcatttgatatcac

SEQ ID NO: 236042 - DNA, 25 bp, Artificial sequence
  SiRNA target sequence
taaatatgcagcatttgatatcaca

SEQ ID NO: 236043 - DNA, 25 bp, Artificial sequence
  SiRNA target sequence
aaatatgcagcatttgatatcacaa

SEQ ID NO: 236044 - DNA, 25 bp, Artificial sequence
  SiRNA target sequence
aatatgcagcatttgatatcacaaa

SEQ ID NO: 236045 - DNA, 25 bp, Artificial sequence
  SiRNA target sequence
atatgcagcatttgatatcacaaaa

SEQ ID NO: 236046 - DNA, 25 bp, Artificial sequence
  SiRNA target sequence
tatgcagcatttgatatcacaaaag

SEQ ID NO: 236047 - DNA, 25 bp, Artificial sequence
  SiRNA target sequence
atgcagcatttgatatcacaaaaga

SEQ ID NO: 236048 - DNA, 25 bp, Artificial sequence
  SiRNA target sequence
tgcagcatttgatatcacaaaagag

SEQ ID NO: 236049 - DNA, 25 bp, Artificial sequence
  SiRNA target sequence
gcagcatttgatatcacaaaagagg

SEQ ID NO: 236050 - DNA, 25 bp, Artificial sequence
  SiRNA target sequence
cagcatttgatatcacaaaagaggc

SEQ ID NO: 236051 - DNA, 25 bp, Artificial sequence
  SiRNA target sequence
agcatttgatatcacaaaagaggct

SEQ ID NO: 236052 - DNA, 25 bp, Artificial sequence
  SiRNA target sequence
gcatttgatatcacaaaagaggctt

SEQ ID NO: 236053 - DNA, 25 bp, Artificial sequence
  SiRNA target sequence
catttgatatcacaaaagaggcttt

SEQ ID NO: 236054 - DNA, 25 bp, Artificial sequence
  SiRNA target sequence
atttgatatcacaaaagaggctttg

SEQ ID NO: 236055 - DNA, 25 bp, Artificial sequence
  SiRNA target sequence
tttgatatcacaaaagaggctttgt

SEQ ID NO: 236056 - DNA, 25 bp, Artificial sequence
  SiRNA target sequence
ttgatatcacaaaagaggctttgtc

SEQ ID NO: 236057 - DNA, 25 bp, Artificial sequence
  SiRNA target sequence
tgatatcacaaaagaggctttgtct

SEQ ID NO: 236058 - DNA, 25 bp, Artificial sequence
  SiRNA target sequence
gatatcacaaaagaggctttgtcta

SEQ ID NO: 236059 - DNA, 25 bp, Artificial sequence
  SiRNA target sequence
atatcacaaaagaggctttgtctat

SEQ ID NO: 236060 - DNA, 25 bp, Artificial sequence
  SiRNA target sequence
tatcacaaaagaggctttgtctatg

SEQ ID NO: 236061 - DNA, 25 bp, Artificial sequence
  SiRNA target sequence
atcacaaaagaggctttgtctatgc

SEQ ID NO: 236062 - DNA, 25 bp, Artificial sequence
  SiRNA target sequence
tcacaaaagaggctttgtctatgca

SEQ ID NO: 236063 - DNA, 25 bp, Artificial sequence
  SiRNA target sequence
cacaaaagaggctttgtctatgcag

SEQ ID NO: 236064 - DNA, 25 bp, Artificial sequence
  SiRNA target sequence
acaaaagaggctttgtctatgcaga

SEQ ID NO: 236065 - DNA, 25 bp, Artificial sequence
  SiRNA target sequence
caaaagaggctttgtctatgcagat

SEQ ID NO: 236066 - DNA, 25 bp, Artificial sequence
  SiRNA target sequence
aaaagaggctttgtctatgcagatt

SEQ ID NO: 236067 - DNA, 25 bp, Artificial sequence
  SiRNA target sequence
aaagaggctttgtctatgcagattg

SEQ ID NO: 236068 - DNA, 25 bp, Artificial sequence
  SiRNA target sequence
aagaggctttgtctatgcagattga

SEQ ID NO: 236069 - DNA, 25 bp, Artificial sequence
  SiRNA target sequence
agaggctttgtctatgcagattgat

SEQ ID NO: 236070 - DNA, 25 bp, Artificial sequence
  SiRNA target sequence
gaggctttgtctatgcagattgatg

SEQ ID NO: 236071 - DNA, 25 bp, Artificial sequence
  SiRNA target sequence
aggctttgtctatgcagattgatgg

SEQ ID NO: 236072 - DNA, 25 bp, Artificial sequence
  SiRNA target sequence
ggctttgtctatgcagattgatggt

SEQ ID NO: 236073 - DNA, 25 bp, Artificial sequence
  SiRNA target sequence
gctttgtctatgcagattgatggtt

SEQ ID NO: 236074 - DNA, 25 bp, Artificial sequence
  SiRNA target sequence
ctttgtctatgcagattgatggttc

SEQ ID NO: 236075 - DNA, 25 bp, Artificial sequence
  SiRNA target sequence
tttgtctatgcagattgatggttct

SEQ ID NO: 236076 - DNA, 25 bp, Artificial sequence
  SiRNA target sequence
ttgtctatgcagattgatggttcta

SEQ ID NO: 236077 - DNA, 25 bp, Artificial sequence
  SiRNA target sequence
tgtctatgcagattgatggttctat

SEQ ID NO: 236078 - DNA, 25 bp, Artificial sequence
  SiRNA target sequence
gtctatgcagattgatggttctata

SEQ ID NO: 236079 - DNA, 25 bp, Artificial sequence
  SiRNA target sequence
tctatgcagattgatggttctataa

SEQ ID NO: 236080 - DNA, 25 bp, Artificial sequence
  SiRNA target sequence
ctatgcagattgatggttctataag

SEQ ID NO: 236081 - DNA, 25 bp, Artificial sequence
  SiRNA target sequence
tatgcagattgatggttctataaga

SEQ ID NO: 236082 - DNA, 25 bp, Artificial sequence
  SiRNA target sequence
atgcagattgatggttctataagag

SEQ ID NO: 236083 - DNA, 25 bp, Artificial sequence
  SiRNA target sequence
tgcagattgatggttctataagagc

SEQ ID NO: 236084 - DNA, 25 bp, Artificial sequence
  SiRNA target sequence
gcagattgatggttctataagagcg

SEQ ID NO: 236085 - DNA, 25 bp, Artificial sequence
  SiRNA target sequence
cagattgatggttctataagagcga

SEQ ID NO: 236086 - DNA, 25 bp, Artificial sequence
  SiRNA target sequence
agattgatggttctataagagcgaa

SEQ ID NO: 236087 - DNA, 25 bp, Artificial sequence
  SiRNA target sequence
gattgatggttctataagagcgaaa

SEQ ID NO: 236088 - DNA, 25 bp, Artificial sequence
  SiRNA target sequence
attgatggttctataagagcgaaat

SEQ ID NO: 236089 - DNA, 25 bp, Artificial sequence
  SiRNA target sequence
ttgatggttctataagagcgaaata

SEQ ID NO: 236090 - DNA, 25 bp, Artificial sequence
  SiRNA target sequence
tgatggttctataagagcgaaatac

SEQ ID NO: 236091 - DNA, 25 bp, Artificial sequence
  SiRNA target sequence
gatggttctataagagcgaaataca

SEQ ID NO: 236092 - DNA, 25 bp, Artificial sequence
  SiRNA target sequence
atggttctataagagcgaaatacaa

SEQ ID NO: 236093 - DNA, 25 bp, Artificial sequence
  SiRNA target sequence
tggttctataagagcgaaatacaaa

SEQ ID NO: 236094 - DNA, 25 bp, Artificial sequence
  SiRNA target sequence
ggttctataagagcgaaatacaaag

SEQ ID NO: 236095 - DNA, 25 bp, Artificial sequence
  SiRNA target sequence
gttctataagagcgaaatacaaagg

SEQ ID NO: 236096 - DNA, 25 bp, Artificial sequence
  SiRNA target sequence
ttctataagagcgaaatacaaaggt

SEQ ID NO: 236097 - DNA, 25 bp, Artificial sequence
  SiRNA target sequence
tctataagagcgaaatacaaaggta

SEQ ID NO: 236098 - DNA, 25 bp, Artificial sequence
  SiRNA target sequence
ctataagagcgaaatacaaaggtat

SEQ ID NO: 236099 - DNA, 25 bp, Artificial sequence
  SiRNA target sequence
tataagagcgaaatacaaaggtatt

SEQ ID NO: 236100 - DNA, 25 bp, Artificial sequence
  SiRNA target sequence
ataagagcgaaatacaaaggtattt

SEQ ID NO: 236101 - DNA, 25 bp, Artificial sequence
  SiRNA target sequence
taagagcgaaatacaaaggtatttt

SEQ ID NO: 236102 - DNA, 25 bp, Artificial sequence
  SiRNA target sequence
aagagcgaaatacaaaggtattttt

SEQ ID NO: 236103 - DNA, 25 bp, Artificial sequence
  SiRNA target sequence
agagcgaaatacaaaggtatttttg

SEQ ID NO: 236104 - DNA, 25 bp, Artificial sequence
  SiRNA target sequence
gagcgaaatacaaaggtatttttga

SEQ ID NO: 236105 - DNA, 25 bp, Artificial sequence
  SiRNA target sequence
agcgaaatacaaaggtatttttgat

SEQ ID NO: 236106 - DNA, 25 bp, Artificial sequence
  SiRNA target sequence
gcgaaatacaaaggtatttttgatg

SEQ ID NO: 236107 - DNA, 25 bp, Artificial sequence
  SiRNA target sequence
cgaaatacaaaggtatttttgatgg

SEQ ID NO: 236108 - DNA, 25 bp, Artificial sequence
  SiRNA target sequence
gaaatacaaaggtatttttgatggt

SEQ ID NO: 236109 - DNA, 25 bp, Artificial sequence
  SiRNA target sequence
aaatacaaaggtatttttgatggtg

SEQ ID NO: 236110 - DNA, 25 bp, Artificial sequence
  SiRNA target sequence
aatacaaaggtatttttgatggtgt

SEQ ID NO: 236111 - DNA, 25 bp, Artificial sequence
  SiRNA target sequence
atacaaaggtatttttgatggtgta

SEQ ID NO: 236112 - DNA, 25 bp, Artificial sequence
  SiRNA target sequence
tacaaaggtatttttgatggtgtat

SEQ ID NO: 236113 - DNA, 25 bp, Artificial sequence
  SiRNA target sequence
acaaaggtatttttgatggtgtatt

SEQ ID NO: 236114 - DNA, 25 bp, Artificial sequence
  SiRNA target sequence
caaaggtatttttgatggtgtattt

SEQ ID NO: 236115 - DNA, 25 bp, Artificial sequence
  SiRNA target sequence
aaaggtatttttgatggtgtatttg

SEQ ID NO: 236116 - DNA, 25 bp, Artificial sequence
  SiRNA target sequence
aaggtatttttgatggtgtatttgg

SEQ ID NO: 236117 - DNA, 25 bp, Artificial sequence
  SiRNA target sequence
aggtatttttgatggtgtatttggt

SEQ ID NO: 236118 - DNA, 25 bp, Artificial sequence
  SiRNA target sequence
ggtatttttgatggtgtatttggta

SEQ ID NO: 236119 - DNA, 25 bp, Artificial sequence
  SiRNA target sequence
gtatttttgatggtgtatttggtaa

SEQ ID NO: 236120 - DNA, 25 bp, Artificial sequence
  SiRNA target sequence
tatttttgatggtgtatttggtaag

SEQ ID NO: 236121 - DNA, 25 bp, Artificial sequence
  SiRNA target sequence
atttttgatggtgtatttggtaagc

SEQ ID NO: 236122 - DNA, 25 bp, Artificial sequence
  SiRNA target sequence
tttttgatggtgtatttggtaagct

SEQ ID NO: 236123 - DNA, 25 bp, Artificial sequence
  SiRNA target sequence
ttttgatggtgtatttggtaagctg

SEQ ID NO: 236124 - DNA, 25 bp, Artificial sequence
  SiRNA target sequence
tttgatggtgtatttggtaagctgg

SEQ ID NO: 236125 - DNA, 25 bp, Artificial sequence
  SiRNA target sequence
ttgatggtgtatttggtaagctggg

SEQ ID NO: 236126 - DNA, 25 bp, Artificial sequence
  SiRNA target sequence
tgatggtgtatttggtaagctgggg

SEQ ID NO: 236127 - DNA, 25 bp, Artificial sequence
  SiRNA target sequence
gatggtgtatttggtaagctgggga

SEQ ID NO: 236128 - DNA, 25 bp, Artificial sequence
  SiRNA target sequence
atggtgtatttggtaagctggggaa

SEQ ID NO: 236129 - DNA, 25 bp, Artificial sequence
  SiRNA target sequence
tggtgtatttggtaagctggggaaa

SEQ ID NO: 236130 - DNA, 25 bp, Artificial sequence
  SiRNA target sequence
ggtgtatttggtaagctggggaaat

SEQ ID NO: 236131 - DNA, 25 bp, Artificial sequence
  SiRNA target sequence
gtgtatttggtaagctggggaaatc

SEQ ID NO: 236132 - DNA, 25 bp, Artificial sequence
  SiRNA target sequence
tgtatttggtaagctggggaaatct

SEQ ID NO: 236133 - DNA, 25 bp, Artificial sequence
  SiRNA target sequence
gtatttggtaagctggggaaatctt

SEQ ID NO: 236134 - DNA, 25 bp, Artificial sequence
  SiRNA target sequence
tatttggtaagctggggaaatcttt

SEQ ID NO: 236135 - DNA, 25 bp, Artificial sequence
  SiRNA target sequence
atttggtaagctggggaaatctttt

SEQ ID NO: 236136 - DNA, 25 bp, Artificial sequence
  SiRNA target sequence
tttggtaagctggggaaatcttttg

SEQ ID NO: 236137 - DNA, 25 bp, Artificial sequence
  SiRNA target sequence
ttggtaagctggggaaatcttttgg

SEQ ID NO: 236138 - DNA, 25 bp, Artificial sequence
  SiRNA target sequence
tggtaagctggggaaatcttttgga

SEQ ID NO: 236139 - DNA, 25 bp, Artificial sequence
  SiRNA target sequence
ggtaagctggggaaatcttttggat

SEQ ID NO: 236140 - DNA, 25 bp, Artificial sequence
  SiRNA target sequence
gtaagctggggaaatcttttggatc

SEQ ID NO: 236141 - DNA, 25 bp, Artificial sequence
  SiRNA target sequence
taagctggggaaatcttttggatca

SEQ ID NO: 236142 - DNA, 25 bp, Artificial sequence
  SiRNA target sequence
aagctggggaaatcttttggatcag

SEQ ID NO: 236143 - DNA, 25 bp, Artificial sequence
  SiRNA target sequence
agctggggaaatcttttggatcagt

SEQ ID NO: 236144 - DNA, 25 bp, Artificial sequence
  SiRNA target sequence
gctggggaaatcttttggatcagtt

SEQ ID NO: 236145 - DNA, 25 bp, Artificial sequence
  SiRNA target sequence
ctggggaaatcttttggatcagttt

SEQ ID NO: 236146 - DNA, 25 bp, Artificial sequence
  SiRNA target sequence
tggggaaatcttttggatcagttta

SEQ ID NO: 236147 - DNA, 25 bp, Artificial sequence
  SiRNA target sequence
ggggaaatcttttggatcagtttat

SEQ ID NO: 236148 - DNA, 25 bp, Artificial sequence
  SiRNA target sequence
gggaaatcttttggatcagtttatg

SEQ ID NO: 236149 - DNA, 25 bp, Artificial sequence
  SiRNA target sequence
ggaaatcttttggatcagtttatgg

SEQ ID NO: 236150 - DNA, 25 bp, Artificial sequence
  SiRNA target sequence
gaaatcttttggatcagtttatgga

SEQ ID NO: 236151 - DNA, 25 bp, Artificial sequence
  SiRNA target sequence
aaatcttttggatcagtttatggat

SEQ ID NO: 236152 - DNA, 25 bp, Artificial sequence
  SiRNA target sequence
aatcttttggatcagtttatggatt

SEQ ID NO: 236153 - DNA, 25 bp, Artificial sequence
  SiRNA target sequence
atcttttggatcagtttatggattt

SEQ ID NO: 236154 - DNA, 25 bp, Artificial sequence
  SiRNA target sequence
tcttttggatcagtttatggattta

SEQ ID NO: 236155 - DNA, 25 bp, Artificial sequence
  SiRNA target sequence
cttttggatcagtttatggatttac

SEQ ID NO: 236156 - DNA, 25 bp, Artificial sequence
  SiRNA target sequence
ttttggatcagtttatggatttaca

SEQ ID NO: 236157 - DNA, 25 bp, Artificial sequence
  SiRNA target sequence
tttggatcagtttatggatttacaa

SEQ ID NO: 236158 - DNA, 25 bp, Artificial sequence
  SiRNA target sequence
ttggatcagtttatggatttacaat

SEQ ID NO: 236159 - DNA, 25 bp, Artificial sequence
  SiRNA target sequence
tggatcagtttatggatttacaatt

SEQ ID NO: 236160 - DNA, 25 bp, Artificial sequence
  SiRNA target sequence
ggatcagtttatggatttacaatta

SEQ ID NO: 236161 - DNA, 25 bp, Artificial sequence
  SiRNA target sequence
gatcagtttatggatttacaattac

SEQ ID NO: 236162 - DNA, 25 bp, Artificial sequence
  SiRNA target sequence
atcagtttatggatttacaattact

SEQ ID NO: 236163 - DNA, 25 bp, Artificial sequence
  SiRNA target sequence
tcagtttatggatttacaattacta

SEQ ID NO: 236164 - DNA, 25 bp, Artificial sequence
  SiRNA target sequence
cagtttatggatttacaattactac

SEQ ID NO: 236165 - DNA, 25 bp, Artificial sequence
  SiRNA target sequence
agtttatggatttacaattactaca

SEQ ID NO: 236166 - DNA, 25 bp, Artificial sequence
  SiRNA target sequence
gtttatggatttacaattactacat

SEQ ID NO: 236167 - DNA, 25 bp, Artificial sequence
  SiRNA target sequence
tttatggatttacaattactacatt

SEQ ID NO: 236168 - DNA, 25 bp, Artificial sequence
  SiRNA target sequence
ttatggatttacaattactacatta

SEQ ID NO: 236169 - DNA, 25 bp, Artificial sequence
  SiRNA target sequence
tatggatttacaattactacattat

SEQ ID NO: 236170 - DNA, 25 bp, Artificial sequence
  SiRNA target sequence
atggatttacaattactacattatt

SEQ ID NO: 236171 - DNA, 25 bp, Artificial sequence
  SiRNA target sequence
tggatttacaattactacattatta

SEQ ID NO: 236172 - DNA, 25 bp, Artificial sequence
  SiRNA target sequence
ggatttacaattactacattattag

SEQ ID NO: 236173 - DNA, 25 bp, Artificial sequence
  SiRNA target sequence
gatttacaattactacattattagg

SEQ ID NO: 236174 - DNA, 25 bp, Artificial sequence
  SiRNA target sequence
atttacaattactacattattagga

SEQ ID NO: 236175 - DNA, 25 bp, Artificial sequence
  SiRNA target sequence
tttacaattactacattattaggaa

SEQ ID NO: 236176 - DNA, 25 bp, Artificial sequence
  SiRNA target sequence
ttacaattactacattattaggaac

SEQ ID NO: 236177 - DNA, 25 bp, Artificial sequence
  SiRNA target sequence
tacaattactacattattaggaaca

SEQ ID NO: 236178 - DNA, 25 bp, Artificial sequence
  SiRNA target sequence
acaattactacattattaggaacaa

SEQ ID NO: 236179 - DNA, 25 bp, Artificial sequence
  SiRNA target sequence
caattactacattattaggaacaag

SEQ ID NO: 236180 - DNA, 25 bp, Artificial sequence
  SiRNA target sequence
aattactacattattaggaacaaga

SEQ ID NO: 236181 - DNA, 25 bp, Artificial sequence
  SiRNA target sequence
attactacattattaggaacaagag

SEQ ID NO: 236182 - DNA, 25 bp, Artificial sequence
  SiRNA target sequence
ttactacattattaggaacaagaga

SEQ ID NO: 236183 - DNA, 25 bp, Artificial sequence
  SiRNA target sequence
tactacattattaggaacaagagat

SEQ ID NO: 236184 - DNA, 25 bp, Artificial sequence
  SiRNA target sequence
actacattattaggaacaagagatg

SEQ ID NO: 236185 - DNA, 25 bp, Artificial sequence
  SiRNA target sequence
ctacattattaggaacaagagatgt

SEQ ID NO: 236186 - DNA, 25 bp, Artificial sequence
  SiRNA target sequence
tacattattaggaacaagagatgtt

SEQ ID NO: 236187 - DNA, 25 bp, Artificial sequence
  SiRNA target sequence
acattattaggaacaagagatgttc

SEQ ID NO: 236188 - DNA, 25 bp, Artificial sequence
  SiRNA target sequence
cattattaggaacaagagatgttcg

SEQ ID NO: 236189 - DNA, 25 bp, Artificial sequence
  SiRNA target sequence
attattaggaacaagagatgttcgt

SEQ ID NO: 236190 - DNA, 25 bp, Artificial sequence
  SiRNA target sequence
ttattaggaacaagagatgttcgta

SEQ ID NO: 236191 - DNA, 25 bp, Artificial sequence
  SiRNA target sequence
tattaggaacaagagatgttcgtag

SEQ ID NO: 236192 - DNA, 25 bp, Artificial sequence
  SiRNA target sequence
attaggaacaagagatgttcgtaga

SEQ ID NO: 236193 - DNA, 25 bp, Artificial sequence
  SiRNA target sequence
ttaggaacaagagatgttcgtagag

SEQ ID NO: 236194 - DNA, 25 bp, Artificial sequence
  SiRNA target sequence
taggaacaagagatgttcgtagagg

SEQ ID NO: 236195 - DNA, 25 bp, Artificial sequence
  SiRNA target sequence
aggaacaagagatgttcgtagaggt

SEQ ID NO: 236196 - DNA, 25 bp, Artificial sequence
  SiRNA target sequence
ggaacaagagatgttcgtagaggtg

SEQ ID NO: 236197 - DNA, 25 bp, Artificial sequence
  SiRNA target sequence
gaacaagagatgttcgtagaggtgc

SEQ ID NO: 236198 - DNA, 25 bp, Artificial sequence
  SiRNA target sequence
aacaagagatgttcgtagaggtgct

SEQ ID NO: 236199 - DNA, 25 bp, Artificial sequence
  SiRNA target sequence
acaagagatgttcgtagaggtgctc

SEQ ID NO: 236200 - DNA, 25 bp, Artificial sequence
  SiRNA target sequence
caagagatgttcgtagaggtgctcc

SEQ ID NO: 236201 - DNA, 25 bp, Artificial sequence
  SiRNA target sequence
aagagatgttcgtagaggtgctcct

SEQ ID NO: 236202 - DNA, 25 bp, Artificial sequence
  SiRNA target sequence
agagatgttcgtagaggtgctccta

SEQ ID NO: 236203 - DNA, 25 bp, Artificial sequence
  SiRNA target sequence
gagatgttcgtagaggtgctcctat

SEQ ID NO: 236204 - DNA, 25 bp, Artificial sequence
  SiRNA target sequence
agatgttcgtagaggtgctcctata

SEQ ID NO: 236205 - DNA, 25 bp, Artificial sequence
  SiRNA target sequence
gatgttcgtagaggtgctcctatat

SEQ ID NO: 236206 - DNA, 25 bp, Artificial sequence
  SiRNA target sequence
atgttcgtagaggtgctcctatatc

SEQ ID NO: 236207 - DNA, 25 bp, Artificial sequence
  SiRNA target sequence
tgttcgtagaggtgctcctatatcg

SEQ ID NO: 236208 - DNA, 25 bp, Artificial sequence
  SiRNA target sequence
gttcgtagaggtgctcctatatcgc

SEQ ID NO: 236209 - DNA, 25 bp, Artificial sequence
  SiRNA target sequence
ttcgtagaggtgctcctatatcgct

SEQ ID NO: 236210 - DNA, 25 bp, Artificial sequence
  SiRNA target sequence
tcgtagaggtgctcctatatcgctt

SEQ ID NO: 236211 - DNA, 25 bp, Artificial sequence
  SiRNA target sequence
cgtagaggtgctcctatatcgcttt

SEQ ID NO: 236212 - DNA, 25 bp, Artificial sequence
  SiRNA target sequence
gtagaggtgctcctatatcgctttg

SEQ ID NO: 236213 - DNA, 25 bp, Artificial sequence
  SiRNA target sequence
tagaggtgctcctatatcgctttgt

SEQ ID NO: 236214 - DNA, 25 bp, Artificial sequence
  SiRNA target sequence
agaggtgctcctatatcgctttgtg

SEQ ID NO: 236215 - DNA, 25 bp, Artificial sequence
  SiRNA target sequence
gaggtgctcctatatcgctttgtgt

SEQ ID NO: 236216 - DNA, 25 bp, Artificial sequence
  SiRNA target sequence
aggtgctcctatatcgctttgtgtt

SEQ ID NO: 236217 - DNA, 25 bp, Artificial sequence
  SiRNA target sequence
ggtgctcctatatcgctttgtgttc

SEQ ID NO: 236218 - DNA, 25 bp, Artificial sequence
  SiRNA target sequence
gtgctcctatatcgctttgtgttct

SEQ ID NO: 236219 - DNA, 25 bp, Artificial sequence
  SiRNA target sequence
tgctcctatatcgctttgtgttcta

SEQ ID NO: 236220 - DNA, 25 bp, Artificial sequence
  SiRNA target sequence
gctcctatatcgctttgtgttctaa

SEQ ID NO: 236221 - DNA, 25 bp, Artificial sequence
  SiRNA target sequence
ctcctatatcgctttgtgttctaat

SEQ ID NO: 236222 - DNA, 25 bp, Artificial sequence
  SiRNA target sequence
tcctatatcgctttgtgttctaata

SEQ ID NO: 236223 - DNA, 25 bp, Artificial sequence
  SiRNA target sequence
cctatatcgctttgtgttctaatat

SEQ ID NO: 236224 - DNA, 25 bp, Artificial sequence
  SiRNA target sequence
ctatatcgctttgtgttctaatatt

SEQ ID NO: 236225 - DNA, 25 bp, Artificial sequence
  SiRNA target sequence
tatatcgctttgtgttctaatattg

SEQ ID NO: 236226 - DNA, 25 bp, Artificial sequence
  SiRNA target sequence
atatcgctttgtgttctaatattgt

SEQ ID NO: 236227 - DNA, 25 bp, Artificial sequence
  SiRNA target sequence
tatcgctttgtgttctaatattgtt

SEQ ID NO: 236228 - DNA, 25 bp, Artificial sequence
  SiRNA target sequence
atcgctttgtgttctaatattgttc

SEQ ID NO: 236229 - DNA, 25 bp, Artificial sequence
  SiRNA target sequence
tcgctttgtgttctaatattgttct

SEQ ID NO: 236230 - DNA, 25 bp, Artificial sequence
  SiRNA target sequence
cgctttgtgttctaatattgttctg

SEQ ID NO: 236231 - DNA, 25 bp, Artificial sequence
  SiRNA target sequence
gctttgtgttctaatattgttctgc

SEQ ID NO: 236232 - DNA, 25 bp, Artificial sequence
  SiRNA target sequence
ctttgtgttctaatattgttctgcc

SEQ ID NO: 236233 - DNA, 25 bp, Artificial sequence
  SiRNA target sequence
tttgtgttctaatattgttctgcct

SEQ ID NO: 236234 - DNA, 25 bp, Artificial sequence
  SiRNA target sequence
ttgtgttctaatattgttctgcctt

SEQ ID NO: 236235 - DNA, 25 bp, Artificial sequence
  SiRNA target sequence
tgtgttctaatattgttctgcctta

SEQ ID NO: 236236 - DNA, 25 bp, Artificial sequence
  SiRNA target sequence
gtgttctaatattgttctgccttat

SEQ ID NO: 236237 - DNA, 25 bp, Artificial sequence
  SiRNA target sequence
tgttctaatattgttctgccttata

SEQ ID NO: 236238 - DNA, 25 bp, Artificial sequence
  SiRNA target sequence
gttctaatattgttctgccttatat

SEQ ID NO: 236239 - DNA, 25 bp, Artificial sequence
  SiRNA target sequence
ttctaatattgttctgccttatatg

SEQ ID NO: 236240 - DNA, 25 bp, Artificial sequence
  SiRNA target sequence
tctaatattgttctgccttatatgg

SEQ ID NO: 236241 - DNA, 25 bp, Artificial sequence
  SiRNA target sequence
ctaatattgttctgccttatatggt

SEQ ID NO: 236242 - DNA, 25 bp, Artificial sequence
  SiRNA target sequence
taatattgttctgccttatatggtt

SEQ ID NO: 236243 - DNA, 25 bp, Artificial sequence
  SiRNA target sequence
aatattgttctgccttatatggttt

SEQ ID NO: 236244 - DNA, 25 bp, Artificial sequence
  SiRNA target sequence
atattgttctgccttatatggtttt

SEQ ID NO: 236245 - DNA, 25 bp, Artificial sequence
  SiRNA target sequence
tattgttctgccttatatggtttta

SEQ ID NO: 236246 - DNA, 25 bp, Artificial sequence
  SiRNA target sequence
attgttctgccttatatggttttat

SEQ ID NO: 236247 - DNA, 25 bp, Artificial sequence
  SiRNA target sequence
ttgttctgccttatatggttttatt

SEQ ID NO: 236248 - DNA, 25 bp, Artificial sequence
  SiRNA target sequence
tgttctgccttatatggttttattc

SEQ ID NO: 236249 - DNA, 25 bp, Artificial sequence
  SiRNA target sequence
gttctgccttatatggttttattct

SEQ ID NO: 236250 - DNA, 25 bp, Artificial sequence
  SiRNA target sequence
ttctgccttatatggttttattctg

SEQ ID NO: 236251 - DNA, 25 bp, Artificial sequence
  SiRNA target sequence
tctgccttatatggttttattctgt

SEQ ID NO: 236252 - DNA, 25 bp, Artificial sequence
  SiRNA target sequence
ctgccttatatggttttattctgtt

SEQ ID NO: 236253 - DNA, 25 bp, Artificial sequence
  SiRNA target sequence
tgccttatatggttttattctgttt

SEQ ID NO: 236254 - DNA, 25 bp, Artificial sequence
  SiRNA target sequence
gccttatatggttttattctgtttt

SEQ ID NO: 236255 - DNA, 25 bp, Artificial sequence
  SiRNA target sequence
ccttatatggttttattctgttttc

SEQ ID NO: 236256 - DNA, 25 bp, Artificial sequence
  SiRNA target sequence
cttatatggttttattctgttttct

SEQ ID NO: 236257 - DNA, 25 bp, Artificial sequence
  SiRNA target sequence
ttatatggttttattctgttttcta

SEQ ID NO: 236258 - DNA, 25 bp, Artificial sequence
  SiRNA target sequence
tatatggttttattctgttttctat

SEQ ID NO: 236259 - DNA, 25 bp, Artificial sequence
  SiRNA target sequence
atatggttttattctgttttctatc

SEQ ID NO: 236260 - DNA, 25 bp, Artificial sequence
  SiRNA target sequence
tatggttttattctgttttctatct

SEQ ID NO: 236261 - DNA, 25 bp, Artificial sequence
  SiRNA target sequence
atggttttattctgttttctatctc

SEQ ID NO: 236262 - DNA, 25 bp, Artificial sequence
  SiRNA target sequence
tggttttattctgttttctatctca

SEQ ID NO: 236263 - DNA, 25 bp, Artificial sequence
  SiRNA target sequence
ggttttattctgttttctatctcaa

SEQ ID NO: 236264 - DNA, 25 bp, Artificial sequence
  SiRNA target sequence
gttttattctgttttctatctcaat

SEQ ID NO: 236265 - DNA, 25 bp, Artificial sequence
  SiRNA target sequence
ttttattctgttttctatctcaata

SEQ ID NO: 236266 - DNA, 25 bp, Artificial sequence
  SiRNA target sequence
tttattctgttttctatctcaatag

SEQ ID NO: 236267 - DNA, 25 bp, Artificial sequence
  SiRNA target sequence
ttattctgttttctatctcaataga

SEQ ID NO: 236268 - DNA, 25 bp, Artificial sequence
  SiRNA target sequence
tattctgttttctatctcaatagaa

SEQ ID NO: 236269 - DNA, 25 bp, Artificial sequence
  SiRNA target sequence
attctgttttctatctcaatagaaa

SEQ ID NO: 236270 - DNA, 25 bp, Artificial sequence
  SiRNA target sequence
ttctgttttctatctcaatagaaaa

SEQ ID NO: 236271 - DNA, 25 bp, Artificial sequence
  SiRNA target sequence
tctgttttctatctcaatagaaaat

SEQ ID NO: 236272 - DNA, 25 bp, Artificial sequence
  SiRNA target sequence
ctgttttctatctcaatagaaaata

SEQ ID NO: 236273 - DNA, 25 bp, Artificial sequence
  SiRNA target sequence
tgttttctatctcaatagaaaatat

SEQ ID NO: 236274 - DNA, 25 bp, Artificial sequence
  SiRNA target sequence
gttttctatctcaatagaaaatata

SEQ ID NO: 236275 - DNA, 25 bp, Artificial sequence
  SiRNA target sequence
ttttctatctcaatagaaaatataa

SEQ ID NO: 236276 - DNA, 25 bp, Artificial sequence
  SiRNA target sequence
tttctatctcaatagaaaatataaa

SEQ ID NO: 236277 - DNA, 25 bp, Artificial sequence
  SiRNA target sequence
ttctatctcaatagaaaatataaag

SEQ ID NO: 236278 - DNA, 25 bp, Artificial sequence
  SiRNA target sequence
tctatctcaatagaaaatataaaga

SEQ ID NO: 236279 - DNA, 25 bp, Artificial sequence
  SiRNA target sequence
ctatctcaatagaaaatataaagaa

SEQ ID NO: 236280 - DNA, 25 bp, Artificial sequence
  SiRNA target sequence
tatctcaatagaaaatataaagaat

SEQ ID NO: 236281 - DNA, 25 bp, Artificial sequence
  SiRNA target sequence
atctcaatagaaaatataaagaatc

SEQ ID NO: 236282 - DNA, 25 bp, Artificial sequence
  SiRNA target sequence
tctcaatagaaaatataaagaatct

SEQ ID NO: 236283 - DNA, 25 bp, Artificial sequence
  SiRNA target sequence
ctcaatagaaaatataaagaatctg

SEQ ID NO: 236284 - DNA, 25 bp, Artificial sequence
  SiRNA target sequence
tcaatagaaaatataaagaatctgt

SEQ ID NO: 236285 - DNA, 25 bp, Artificial sequence
  SiRNA target sequence
caatagaaaatataaagaatctgtc

SEQ ID NO: 236286 - DNA, 25 bp, Artificial sequence
  SiRNA target sequence
aatagaaaatataaagaatctgtcg

SEQ ID NO: 236287 - DNA, 25 bp, Artificial sequence
  SiRNA target sequence
atagaaaatataaagaatctgtcga

SEQ ID NO: 236288 - DNA, 25 bp, Artificial sequence
  SiRNA target sequence
tagaaaatataaagaatctgtcgag

SEQ ID NO: 236289 - DNA, 25 bp, Artificial sequence
  SiRNA target sequence
agaaaatataaagaatctgtcgaga

SEQ ID NO: 236290 - DNA, 25 bp, Artificial sequence
  SiRNA target sequence
gaaaatataaagaatctgtcgagaa

SEQ ID NO: 236291 - DNA, 25 bp, Artificial sequence
  SiRNA target sequence
aaaatataaagaatctgtcgagaat

SEQ ID NO: 236292 - DNA, 25 bp, Artificial sequence
  SiRNA target sequence
aaatataaagaatctgtcgagaata

SEQ ID NO: 236293 - DNA, 25 bp, Artificial sequence
  SiRNA target sequence
aatataaagaatctgtcgagaataa

SEQ ID NO: 236294 - DNA, 25 bp, Artificial sequence
  SiRNA target sequence
atataaagaatctgtcgagaataat

SEQ ID NO: 236295 - DNA, 25 bp, Artificial sequence
  SiRNA target sequence
tataaagaatctgtcgagaataatg

SEQ ID NO: 236296 - DNA, 25 bp, Artificial sequence
  SiRNA target sequence
ataaagaatctgtcgagaataatgc

SEQ ID NO: 236297 - DNA, 25 bp, Artificial sequence
  SiRNA target sequence
taaagaatctgtcgagaataatgca

SEQ ID NO: 236298 - DNA, 25 bp, Artificial sequence
  SiRNA target sequence
aaagaatctgtcgagaataatgcac

SEQ ID NO: 236299 - DNA, 25 bp, Artificial sequence
  SiRNA target sequence
aagaatctgtcgagaataatgcacc

SEQ ID NO: 236300 - DNA, 25 bp, Artificial sequence
  SiRNA target sequence
agaatctgtcgagaataatgcacca

SEQ ID NO: 236301 - DNA, 25 bp, Artificial sequence
  SiRNA target sequence
gaatctgtcgagaataatgcaccaa

SEQ ID NO: 236302 - DNA, 25 bp, Artificial sequence
  SiRNA target sequence
aatctgtcgagaataatgcaccaat

SEQ ID NO: 236303 - DNA, 25 bp, Artificial sequence
  SiRNA target sequence
atctgtcgagaataatgcaccaatt

SEQ ID NO: 236304 - DNA, 25 bp, Artificial sequence
  SiRNA target sequence
tctgtcgagaataatgcaccaattg

SEQ ID NO: 236305 - DNA, 25 bp, Artificial sequence
  SiRNA target sequence
ctgtcgagaataatgcaccaattga

SEQ ID NO: 236306 - DNA, 25 bp, Artificial sequence
  SiRNA target sequence
tgtcgagaataatgcaccaattgat

SEQ ID NO: 236307 - DNA, 25 bp, Artificial sequence
  SiRNA target sequence
gtcgagaataatgcaccaattgata

SEQ ID NO: 236308 - DNA, 25 bp, Artificial sequence
  SiRNA target sequence
tcgagaataatgcaccaattgatat

SEQ ID NO: 236309 - DNA, 25 bp, Artificial sequence
  SiRNA target sequence
cgagaataatgcaccaattgatatt

SEQ ID NO: 236310 - DNA, 25 bp, Artificial sequence
  SiRNA target sequence
gagaataatgcaccaattgatattg

SEQ ID NO: 236311 - DNA, 25 bp, Artificial sequence
  SiRNA target sequence
agaataatgcaccaattgatattga

SEQ ID NO: 236312 - DNA, 25 bp, Artificial sequence
  SiRNA target sequence
gaataatgcaccaattgatattgat

SEQ ID NO: 236313 - DNA, 25 bp, Artificial sequence
  SiRNA target sequence
aataatgcaccaattgatattgatt

SEQ ID NO: 236314 - DNA, 25 bp, Artificial sequence
  SiRNA target sequence
ataatgcaccaattgatattgattt

SEQ ID NO: 236315 - DNA, 25 bp, Artificial sequence
  SiRNA target sequence
taatgcaccaattgatattgattta

SEQ ID NO: 236316 - DNA, 25 bp, Artificial sequence
  SiRNA target sequence
aatgcaccaattgatattgatttat

SEQ ID NO: 236317 - DNA, 25 bp, Artificial sequence
  SiRNA target sequence
atgcaccaattgatattgatttatt

SEQ ID NO: 236318 - DNA, 25 bp, Artificial sequence
  SiRNA target sequence
tgcaccaattgatattgatttattc

SEQ ID NO: 236319 - DNA, 25 bp, Artificial sequence
  SiRNA target sequence
gcaccaattgatattgatttattca

SEQ ID NO: 236320 - DNA, 25 bp, Artificial sequence
  SiRNA target sequence
caccaattgatattgatttattcac

SEQ ID NO: 236321 - DNA, 25 bp, Artificial sequence
  SiRNA target sequence
accaattgatattgatttattcact

SEQ ID NO: 236322 - DNA, 25 bp, Artificial sequence
  SiRNA target sequence
ccaattgatattgatttattcacta

SEQ ID NO: 236323 - DNA, 25 bp, Artificial sequence
  SiRNA target sequence
caattgatattgatttattcactag

SEQ ID NO: 236324 - DNA, 25 bp, Artificial sequence
  SiRNA target sequence
aattgatattgatttattcactagt

SEQ ID NO: 236325 - DNA, 25 bp, Artificial sequence
  SiRNA target sequence
attgatattgatttattcactagtt

SEQ ID NO: 236326 - DNA, 25 bp, Artificial sequence
  SiRNA target sequence
ttgatattgatttattcactagttc

SEQ ID NO: 236327 - DNA, 25 bp, Artificial sequence
  SiRNA target sequence
tgatattgatttattcactagttca

SEQ ID NO: 236328 - DNA, 25 bp, Artificial sequence
  SiRNA target sequence
gatattgatttattcactagttcaa

SEQ ID NO: 236329 - DNA, 25 bp, Artificial sequence
  SiRNA target sequence
atattgatttattcactagttcaaa

SEQ ID NO: 236330 - DNA, 25 bp, Artificial sequence
  SiRNA target sequence
tattgatttattcactagttcaaaa

SEQ ID NO: 236331 - DNA, 25 bp, Artificial sequence
  SiRNA target sequence
attgatttattcactagttcaaaag

SEQ ID NO: 236332 - DNA, 25 bp, Artificial sequence
  SiRNA target sequence
ttgatttattcactagttcaaaagt

SEQ ID NO: 236333 - DNA, 25 bp, Artificial sequence
  SiRNA target sequence
tgatttattcactagttcaaaagtc

SEQ ID NO: 236334 - DNA, 25 bp, Artificial sequence
  SiRNA target sequence
gatttattcactagttcaaaagtca

SEQ ID NO: 236335 - DNA, 25 bp, Artificial sequence
  SiRNA target sequence
atttattcactagttcaaaagtcaa

SEQ ID NO: 236336 - DNA, 25 bp, Artificial sequence
  SiRNA target sequence
tttattcactagttcaaaagtcaag

SEQ ID NO: 236337 - DNA, 25 bp, Artificial sequence
  SiRNA target sequence
ttattcactagttcaaaagtcaagg

SEQ ID NO: 236338 - DNA, 25 bp, Artificial sequence
  SiRNA target sequence
tattcactagttcaaaagtcaaggc

SEQ ID NO: 236339 - DNA, 25 bp, Artificial sequence
  SiRNA target sequence
attcactagttcaaaagtcaaggca

SEQ ID NO: 236340 - DNA, 25 bp, Artificial sequence
  SiRNA target sequence
ttcactagttcaaaagtcaaggcac

SEQ ID NO: 236341 - DNA, 25 bp, Artificial sequence
  SiRNA target sequence
tcactagttcaaaagtcaaggcacc

SEQ ID NO: 236342 - DNA, 25 bp, Artificial sequence
  SiRNA target sequence
cactagttcaaaagtcaaggcacct

SEQ ID NO: 236343 - DNA, 25 bp, Artificial sequence
  SiRNA target sequence
actagttcaaaagtcaaggcacctt

SEQ ID NO: 236344 - DNA, 25 bp, Artificial sequence
  SiRNA target sequence
ctagttcaaaagtcaaggcaccttc

SEQ ID NO: 236345 - DNA, 25 bp, Artificial sequence
  SiRNA target sequence
tagttcaaaagtcaaggcaccttct

SEQ ID NO: 236346 - DNA, 25 bp, Artificial sequence
  SiRNA target sequence
agttcaaaagtcaaggcaccttctt

SEQ ID NO: 236347 - DNA, 25 bp, Artificial sequence
  SiRNA target sequence
gttcaaaagtcaaggcaccttcttc

SEQ ID NO: 236348 - DNA, 25 bp, Artificial sequence
  SiRNA target sequence
ttcaaaagtcaaggcaccttcttct

SEQ ID NO: 236349 - DNA, 25 bp, Artificial sequence
  SiRNA target sequence
tcaaaagtcaaggcaccttcttctg

SEQ ID NO: 236350 - DNA, 25 bp, Artificial sequence
  SiRNA target sequence
caaaagtcaaggcaccttcttctga

SEQ ID NO: 236351 - DNA, 25 bp, Artificial sequence
  SiRNA target sequence
aaaagtcaaggcaccttcttctgaa

SEQ ID NO: 236352 - DNA, 25 bp, Artificial sequence
  SiRNA target sequence
aaagtcaaggcaccttcttctgaac

SEQ ID NO: 236353 - DNA, 25 bp, Artificial sequence
  SiRNA target sequence
aagtcaaggcaccttcttctgaacc

SEQ ID NO: 236354 - DNA, 25 bp, Artificial sequence
  SiRNA target sequence
agtcaaggcaccttcttctgaacct

SEQ ID NO: 236355 - DNA, 25 bp, Artificial sequence
  SiRNA target sequence
gtcaaggcaccttcttctgaaccta

SEQ ID NO: 236356 - DNA, 25 bp, Artificial sequence
  SiRNA target sequence
tcaaggcaccttcttctgaacctac

SEQ ID NO: 236357 - DNA, 25 bp, Artificial sequence
  SiRNA target sequence
caaggcaccttcttctgaacctact

SEQ ID NO: 236358 - DNA, 25 bp, Artificial sequence
  SiRNA target sequence
aaggcaccttcttctgaacctactg

SEQ ID NO: 236359 - DNA, 25 bp, Artificial sequence
  SiRNA target sequence
aggcaccttcttctgaacctactgt

SEQ ID NO: 236360 - DNA, 25 bp, Artificial sequence
  SiRNA target sequence
ggcaccttcttctgaacctactgtt

SEQ ID NO: 236361 - DNA, 25 bp, Artificial sequence
  SiRNA target sequence
gcaccttcttctgaacctactgttg

SEQ ID NO: 236362 - DNA, 25 bp, Artificial sequence
  SiRNA target sequence
caccttcttctgaacctactgttgc

SEQ ID NO: 236363 - DNA, 25 bp, Artificial sequence
  SiRNA target sequence
accttcttctgaacctactgttgct

SEQ ID NO: 236364 - DNA, 25 bp, Artificial sequence
  SiRNA target sequence
ccttcttctgaacctactgttgcta

SEQ ID NO: 236365 - DNA, 25 bp, Artificial sequence
  SiRNA target sequence
cttcttctgaacctactgttgctac

SEQ ID NO: 236366 - DNA, 25 bp, Artificial sequence
  SiRNA target sequence
ttcttctgaacctactgttgctacc

SEQ ID NO: 236367 - DNA, 25 bp, Artificial sequence
  SiRNA target sequence
tcttctgaacctactgttgctacca

SEQ ID NO: 236368 - DNA, 25 bp, Artificial sequence
  SiRNA target sequence
cttctgaacctactgttgctaccaa

SEQ ID NO: 236369 - DNA, 25 bp, Artificial sequence
  SiRNA target sequence
ttctgaacctactgttgctaccaaa

SEQ ID NO: 236370 - DNA, 25 bp, Artificial sequence
  SiRNA target sequence
tctgaacctactgttgctaccaaaa

SEQ ID NO: 236371 - DNA, 25 bp, Artificial sequence
  SiRNA target sequence
ctgaacctactgttgctaccaaaag

SEQ ID NO: 236372 - DNA, 25 bp, Artificial sequence
  SiRNA target sequence
tgaacctactgttgctaccaaaagt

SEQ ID NO: 236373 - DNA, 25 bp, Artificial sequence
  SiRNA target sequence
gaacctactgttgctaccaaaagtg

SEQ ID NO: 236374 - DNA, 25 bp, Artificial sequence
  SiRNA target sequence
aacctactgttgctaccaaaagtgt

SEQ ID NO: 236375 - DNA, 25 bp, Artificial sequence
  SiRNA target sequence
acctactgttgctaccaaaagtgtt

SEQ ID NO: 236376 - DNA, 25 bp, Artificial sequence
  SiRNA target sequence
cctactgttgctaccaaaagtgtta

SEQ ID NO: 236377 - DNA, 25 bp, Artificial sequence
  SiRNA target sequence
ctactgttgctaccaaaagtgttac

SEQ ID NO: 236378 - DNA, 25 bp, Artificial sequence
  SiRNA target sequence
tactgttgctaccaaaagtgttact

SEQ ID NO: 236379 - DNA, 25 bp, Artificial sequence
  SiRNA target sequence
actgttgctaccaaaagtgttacta

SEQ ID NO: 236380 - DNA, 25 bp, Artificial sequence
  SiRNA target sequence
ctgttgctaccaaaagtgttactac

SEQ ID NO: 236381 - DNA, 25 bp, Artificial sequence
  SiRNA target sequence
tgttgctaccaaaagtgttactaca

SEQ ID NO: 236382 - DNA, 25 bp, Artificial sequence
  SiRNA target sequence
gttgctaccaaaagtgttactacag

SEQ ID NO: 236383 - DNA, 25 bp, Artificial sequence
  SiRNA target sequence
ttgctaccaaaagtgttactacaga

SEQ ID NO: 236384 - DNA, 25 bp, Artificial sequence
  SiRNA target sequence
tgctaccaaaagtgttactacagaa

SEQ ID NO: 236385 - DNA, 25 bp, Artificial sequence
  SiRNA target sequence
gctaccaaaagtgttactacagaag

SEQ ID NO: 236386 - DNA, 25 bp, Artificial sequence
  SiRNA target sequence
ctaccaaaagtgttactacagaaga

SEQ ID NO: 236387 - DNA, 25 bp, Artificial sequence
  SiRNA target sequence
taccaaaagtgttactacagaagaa

SEQ ID NO: 236388 - DNA, 25 bp, Artificial sequence
  SiRNA target sequence
accaaaagtgttactacagaagaat

SEQ ID NO: 236389 - DNA, 25 bp, Artificial sequence
  SiRNA target sequence
ccaaaagtgttactacagaagaata

SEQ ID NO: 236390 - DNA, 25 bp, Artificial sequence
  SiRNA target sequence
caaaagtgttactacagaagaataa

SEQ ID NO: 236391 - DNA, 26 bp, Artificial sequence
  SiRNA target sequence
atgtcagtagacaattcgaaagttct

SEQ ID NO: 236392 - DNA, 26 bp, Artificial sequence
  SiRNA target sequence
tgtcagtagacaattcgaaagttcta

SEQ ID NO: 236393 - DNA, 26 bp, Artificial sequence
  SiRNA target sequence
gtcagtagacaattcgaaagttctac

SEQ ID NO: 236394 - DNA, 26 bp, Artificial sequence
  SiRNA target sequence
tcagtagacaattcgaaagttctaca

SEQ ID NO: 236395 - DNA, 26 bp, Artificial sequence
  SiRNA target sequence
cagtagacaattcgaaagttctacaa

SEQ ID NO: 236396 - DNA, 26 bp, Artificial sequence
  SiRNA target sequence
agtagacaattcgaaagttctacaaa

SEQ ID NO: 236397 - DNA, 26 bp, Artificial sequence
  SiRNA target sequence
gtagacaattcgaaagttctacaaaa

SEQ ID NO: 236398 - DNA, 26 bp, Artificial sequence
  SiRNA target sequence
tagacaattcgaaagttctacaaaat

SEQ ID NO: 236399 - DNA, 26 bp, Artificial sequence
  SiRNA target sequence
agacaattcgaaagttctacaaaata

SEQ ID NO: 236400 - DNA, 26 bp, Artificial sequence
  SiRNA target sequence
gacaattcgaaagttctacaaaataa

SEQ ID NO: 236401 - DNA, 26 bp, Artificial sequence
  SiRNA target sequence
acaattcgaaagttctacaaaataac

SEQ ID NO: 236402 - DNA, 26 bp, Artificial sequence
  SiRNA target sequence
caattcgaaagttctacaaaataacg

SEQ ID NO: 236403 - DNA, 26 bp, Artificial sequence
  SiRNA target sequence
aattcgaaagttctacaaaataacga

SEQ ID NO: 236404 - DNA, 26 bp, Artificial sequence
  SiRNA target sequence
attcgaaagttctacaaaataacgaa

SEQ ID NO: 236405 - DNA, 26 bp, Artificial sequence
  SiRNA target sequence
ttcgaaagttctacaaaataacgaaa

SEQ ID NO: 236406 - DNA, 26 bp, Artificial sequence
  SiRNA target sequence
tcgaaagttctacaaaataacgaaaa

SEQ ID NO: 236407 - DNA, 26 bp, Artificial sequence
  SiRNA target sequence
cgaaagttctacaaaataacgaaaac

SEQ ID NO: 236408 - DNA, 26 bp, Artificial sequence
  SiRNA target sequence
gaaagttctacaaaataacgaaaact

SEQ ID NO: 236409 - DNA, 26 bp, Artificial sequence
  SiRNA target sequence
aaagttctacaaaataacgaaaactc

SEQ ID NO: 236410 - DNA, 26 bp, Artificial sequence
  SiRNA target sequence
aagttctacaaaataacgaaaactct

SEQ ID NO: 236411 - DNA, 26 bp, Artificial sequence
  SiRNA target sequence
agttctacaaaataacgaaaactctg

SEQ ID NO: 236412 - DNA, 26 bp, Artificial sequence
  SiRNA target sequence
gttctacaaaataacgaaaactctgc

SEQ ID NO: 236413 - DNA, 26 bp, Artificial sequence
  SiRNA target sequence
ttctacaaaataacgaaaactctgct

SEQ ID NO: 236414 - DNA, 26 bp, Artificial sequence
  SiRNA target sequence
tctacaaaataacgaaaactctgctc

SEQ ID NO: 236415 - DNA, 26 bp, Artificial sequence
  SiRNA target sequence
ctacaaaataacgaaaactctgctct

SEQ ID NO: 236416 - DNA, 26 bp, Artificial sequence
  SiRNA target sequence
tacaaaataacgaaaactctgctctt

SEQ ID NO: 236417 - DNA, 26 bp, Artificial sequence
  SiRNA target sequence
acaaaataacgaaaactctgctcttc

SEQ ID NO: 236418 - DNA, 26 bp, Artificial sequence
  SiRNA target sequence
caaaataacgaaaactctgctcttcc

SEQ ID NO: 236419 - DNA, 26 bp, Artificial sequence
  SiRNA target sequence
aaaataacgaaaactctgctcttcct

SEQ ID NO: 236420 - DNA, 26 bp, Artificial sequence
  SiRNA target sequence
aaataacgaaaactctgctcttccta

SEQ ID NO: 236421 - DNA, 26 bp, Artificial sequence
  SiRNA target sequence
aataacgaaaactctgctcttcctac

SEQ ID NO: 236422 - DNA, 26 bp, Artificial sequence
  SiRNA target sequence
ataacgaaaactctgctcttcctaca

SEQ ID NO: 236423 - DNA, 26 bp, Artificial sequence
  SiRNA target sequence
taacgaaaactctgctcttcctacag

SEQ ID NO: 236424 - DNA, 26 bp, Artificial sequence
  SiRNA target sequence
aacgaaaactctgctcttcctacaga

SEQ ID NO: 236425 - DNA, 26 bp, Artificial sequence
  SiRNA target sequence
acgaaaactctgctcttcctacagaa

SEQ ID NO: 236426 - DNA, 26 bp, Artificial sequence
  SiRNA target sequence
cgaaaactctgctcttcctacagaag

SEQ ID NO: 236427 - DNA, 26 bp, Artificial sequence
  SiRNA target sequence
gaaaactctgctcttcctacagaaga

SEQ ID NO: 236428 - DNA, 26 bp, Artificial sequence
  SiRNA target sequence
aaaactctgctcttcctacagaagat

SEQ ID NO: 236429 - DNA, 26 bp, Artificial sequence
  SiRNA target sequence
aaactctgctcttcctacagaagatg

SEQ ID NO: 236430 - DNA, 26 bp, Artificial sequence
  SiRNA target sequence
aactctgctcttcctacagaagatga

SEQ ID NO: 236431 - DNA, 26 bp, Artificial sequence
  SiRNA target sequence
actctgctcttcctacagaagatgaa

SEQ ID NO: 236432 - DNA, 26 bp, Artificial sequence
  SiRNA target sequence
ctctgctcttcctacagaagatgaaa

SEQ ID NO: 236433 - DNA, 26 bp, Artificial sequence
  SiRNA target sequence
tctgctcttcctacagaagatgaaat

SEQ ID NO: 236434 - DNA, 26 bp, Artificial sequence
  SiRNA target sequence
ctgctcttcctacagaagatgaaatt

SEQ ID NO: 236435 - DNA, 26 bp, Artificial sequence
  SiRNA target sequence
tgctcttcctacagaagatgaaattg

SEQ ID NO: 236436 - DNA, 26 bp, Artificial sequence
  SiRNA target sequence
gctcttcctacagaagatgaaattga

SEQ ID NO: 236437 - DNA, 26 bp, Artificial sequence
  SiRNA target sequence
ctcttcctacagaagatgaaattgag

SEQ ID NO: 236438 - DNA, 26 bp, Artificial sequence
  SiRNA target sequence
tcttcctacagaagatgaaattgagt

SEQ ID NO: 236439 - DNA, 26 bp, Artificial sequence
  SiRNA target sequence
cttcctacagaagatgaaattgagta

SEQ ID NO: 236440 - DNA, 26 bp, Artificial sequence
  SiRNA target sequence
ttcctacagaagatgaaattgagtat

SEQ ID NO: 236441 - DNA, 26 bp, Artificial sequence
  SiRNA target sequence
tcctacagaagatgaaattgagtatg

SEQ ID NO: 236442 - DNA, 26 bp, Artificial sequence
  SiRNA target sequence
cctacagaagatgaaattgagtatga

SEQ ID NO: 236443 - DNA, 26 bp, Artificial sequence
  SiRNA target sequence
ctacagaagatgaaattgagtatgag

SEQ ID NO: 236444 - DNA, 26 bp, Artificial sequence
  SiRNA target sequence
tacagaagatgaaattgagtatgagg

SEQ ID NO: 236445 - DNA, 26 bp, Artificial sequence
  SiRNA target sequence
acagaagatgaaattgagtatgaggc

SEQ ID NO: 236446 - DNA, 26 bp, Artificial sequence
  SiRNA target sequence
cagaagatgaaattgagtatgaggcc

SEQ ID NO: 236447 - DNA, 26 bp, Artificial sequence
  SiRNA target sequence
agaagatgaaattgagtatgaggcca

SEQ ID NO: 236448 - DNA, 26 bp, Artificial sequence
  SiRNA target sequence
gaagatgaaattgagtatgaggccag

SEQ ID NO: 236449 - DNA, 26 bp, Artificial sequence
  SiRNA target sequence
aagatgaaattgagtatgaggccagc

SEQ ID NO: 236450 - DNA, 26 bp, Artificial sequence
  SiRNA target sequence
agatgaaattgagtatgaggccagca

SEQ ID NO: 236451 - DNA, 26 bp, Artificial sequence
  SiRNA target sequence
gatgaaattgagtatgaggccagcaa

SEQ ID NO: 236452 - DNA, 26 bp, Artificial sequence
  SiRNA target sequence
atgaaattgagtatgaggccagcaat

SEQ ID NO: 236453 - DNA, 26 bp, Artificial sequence
  SiRNA target sequence
tgaaattgagtatgaggccagcaatg

SEQ ID NO: 236454 - DNA, 26 bp, Artificial sequence
  SiRNA target sequence
gaaattgagtatgaggccagcaatgg

SEQ ID NO: 236455 - DNA, 26 bp, Artificial sequence
  SiRNA target sequence
aaattgagtatgaggccagcaatggt

SEQ ID NO: 236456 - DNA, 26 bp, Artificial sequence
  SiRNA target sequence
aattgagtatgaggccagcaatggtt

SEQ ID NO: 236457 - DNA, 26 bp, Artificial sequence
  SiRNA target sequence
attgagtatgaggccagcaatggttc

SEQ ID NO: 236458 - DNA, 26 bp, Artificial sequence
  SiRNA target sequence
ttgagtatgaggccagcaatggttct

SEQ ID NO: 236459 - DNA, 26 bp, Artificial sequence
  SiRNA target sequence
tgagtatgaggccagcaatggttctg

SEQ ID NO: 236460 - DNA, 26 bp, Artificial sequence
  SiRNA target sequence
gagtatgaggccagcaatggttctgg

SEQ ID NO: 236461 - DNA, 26 bp, Artificial sequence
  SiRNA target sequence
agtatgaggccagcaatggttctggt

SEQ ID NO: 236462 - DNA, 26 bp, Artificial sequence
  SiRNA target sequence
gtatgaggccagcaatggttctggta

SEQ ID NO: 236463 - DNA, 26 bp, Artificial sequence
  SiRNA target sequence
tatgaggccagcaatggttctggtat

SEQ ID NO: 236464 - DNA, 26 bp, Artificial sequence
  SiRNA target sequence
atgaggccagcaatggttctggtata

SEQ ID NO: 236465 - DNA, 26 bp, Artificial sequence
  SiRNA target sequence
tgaggccagcaatggttctggtatat

SEQ ID NO: 236466 - DNA, 26 bp, Artificial sequence
  SiRNA target sequence
gaggccagcaatggttctggtatata

SEQ ID NO: 236467 - DNA, 26 bp, Artificial sequence
  SiRNA target sequence
aggccagcaatggttctggtatatat

SEQ ID NO: 236468 - DNA, 26 bp, Artificial sequence
  SiRNA target sequence
ggccagcaatggttctggtatatatt

SEQ ID NO: 236469 - DNA, 26 bp, Artificial sequence
  SiRNA target sequence
gccagcaatggttctggtatatattc

SEQ ID NO: 236470 - DNA, 26 bp, Artificial sequence
  SiRNA target sequence
ccagcaatggttctggtatatattca

SEQ ID NO: 236471 - DNA, 26 bp, Artificial sequence
  SiRNA target sequence
cagcaatggttctggtatatattcac

SEQ ID NO: 236472 - DNA, 26 bp, Artificial sequence
  SiRNA target sequence
agcaatggttctggtatatattcact

SEQ ID NO: 236473 - DNA, 26 bp, Artificial sequence
  SiRNA target sequence
gcaatggttctggtatatattcactt

SEQ ID NO: 236474 - DNA, 26 bp, Artificial sequence
  SiRNA target sequence
caatggttctggtatatattcactta

SEQ ID NO: 236475 - DNA, 26 bp, Artificial sequence
  SiRNA target sequence
aatggttctggtatatattcacttat

SEQ ID NO: 236476 - DNA, 26 bp, Artificial sequence
  SiRNA target sequence
atggttctggtatatattcacttatt

SEQ ID NO: 236477 - DNA, 26 bp, Artificial sequence
  SiRNA target sequence
tggttctggtatatattcacttatta

SEQ ID NO: 236478 - DNA, 26 bp, Artificial sequence
  SiRNA target sequence
ggttctggtatatattcacttattag

SEQ ID NO: 236479 - DNA, 26 bp, Artificial sequence
  SiRNA target sequence
gttctggtatatattcacttattaga

SEQ ID NO: 236480 - DNA, 26 bp, Artificial sequence
  SiRNA target sequence
ttctggtatatattcacttattagag

SEQ ID NO: 236481 - DNA, 26 bp, Artificial sequence
  SiRNA target sequence
tctggtatatattcacttattagagt

SEQ ID NO: 236482 - DNA, 26 bp, Artificial sequence
  SiRNA target sequence
ctggtatatattcacttattagagta

SEQ ID NO: 236483 - DNA, 26 bp, Artificial sequence
  SiRNA target sequence
tggtatatattcacttattagagtag

SEQ ID NO: 236484 - DNA, 26 bp, Artificial sequence
  SiRNA target sequence
ggtatatattcacttattagagtagc

SEQ ID NO: 236485 - DNA, 26 bp, Artificial sequence
  SiRNA target sequence
gtatatattcacttattagagtagca

SEQ ID NO: 236486 - DNA, 26 bp, Artificial sequence
  SiRNA target sequence
tatatattcacttattagagtagcaa

SEQ ID NO: 236487 - DNA, 26 bp, Artificial sequence
  SiRNA target sequence
atatattcacttattagagtagcaaa

SEQ ID NO: 236488 - DNA, 26 bp, Artificial sequence
  SiRNA target sequence
tatattcacttattagagtagcaaag

SEQ ID NO: 236489 - DNA, 26 bp, Artificial sequence
  SiRNA target sequence
atattcacttattagagtagcaaagg

SEQ ID NO: 236490 - DNA, 26 bp, Artificial sequence
  SiRNA target sequence
tattcacttattagagtagcaaaggt

SEQ ID NO: 236491 - DNA, 26 bp, Artificial sequence
  SiRNA target sequence
attcacttattagagtagcaaaggtt

SEQ ID NO: 236492 - DNA, 26 bp, Artificial sequence
  SiRNA target sequence
ttcacttattagagtagcaaaggttg

SEQ ID NO: 236493 - DNA, 26 bp, Artificial sequence
  SiRNA target sequence
tcacttattagagtagcaaaggttga

SEQ ID NO: 236494 - DNA, 26 bp, Artificial sequence
  SiRNA target sequence
cacttattagagtagcaaaggttgag

SEQ ID NO: 236495 - DNA, 26 bp, Artificial sequence
  SiRNA target sequence
acttattagagtagcaaaggttgaga

SEQ ID NO: 236496 - DNA, 26 bp, Artificial sequence
  SiRNA target sequence
cttattagagtagcaaaggttgagag

SEQ ID NO: 236497 - DNA, 26 bp, Artificial sequence
  SiRNA target sequence
ttattagagtagcaaaggttgagaga

SEQ ID NO: 236498 - DNA, 26 bp, Artificial sequence
  SiRNA target sequence
tattagagtagcaaaggttgagagaa

SEQ ID NO: 236499 - DNA, 26 bp, Artificial sequence
  SiRNA target sequence
attagagtagcaaaggttgagagaaa

SEQ ID NO: 236500 - DNA, 26 bp, Artificial sequence
  SiRNA target sequence
ttagagtagcaaaggttgagagaaag

SEQ ID NO: 236501 - DNA, 26 bp, Artificial sequence
  SiRNA target sequence
tagagtagcaaaggttgagagaaaga

SEQ ID NO: 236502 - DNA, 26 bp, Artificial sequence
  SiRNA target sequence
agagtagcaaaggttgagagaaagat

SEQ ID NO: 236503 - DNA, 26 bp, Artificial sequence
  SiRNA target sequence
gagtagcaaaggttgagagaaagatg

SEQ ID NO: 236504 - DNA, 26 bp, Artificial sequence
  SiRNA target sequence
agtagcaaaggttgagagaaagatgt

SEQ ID NO: 236505 - DNA, 26 bp, Artificial sequence
  SiRNA target sequence
gtagcaaaggttgagagaaagatgtt

SEQ ID NO: 236506 - DNA, 26 bp, Artificial sequence
  SiRNA target sequence
tagcaaaggttgagagaaagatgttt

SEQ ID NO: 236507 - DNA, 26 bp, Artificial sequence
  SiRNA target sequence
agcaaaggttgagagaaagatgtttt

SEQ ID NO: 236508 - DNA, 26 bp, Artificial sequence
  SiRNA target sequence
gcaaaggttgagagaaagatgttttg

SEQ ID NO: 236509 - DNA, 26 bp, Artificial sequence
  SiRNA target sequence
caaaggttgagagaaagatgttttgg

SEQ ID NO: 236510 - DNA, 26 bp, Artificial sequence
  SiRNA target sequence
aaaggttgagagaaagatgttttgga

SEQ ID NO: 236511 - DNA, 26 bp, Artificial sequence
  SiRNA target sequence
aaggttgagagaaagatgttttggat

SEQ ID NO: 236512 - DNA, 26 bp, Artificial sequence
  SiRNA target sequence
aggttgagagaaagatgttttggatc

SEQ ID NO: 236513 - DNA, 26 bp, Artificial sequence
  SiRNA target sequence
ggttgagagaaagatgttttggatca

SEQ ID NO: 236514 - DNA, 26 bp, Artificial sequence
  SiRNA target sequence
gttgagagaaagatgttttggatcat

SEQ ID NO: 236515 - DNA, 26 bp, Artificial sequence
  SiRNA target sequence
ttgagagaaagatgttttggatcatg

SEQ ID NO: 236516 - DNA, 26 bp, Artificial sequence
  SiRNA target sequence
tgagagaaagatgttttggatcatgg

SEQ ID NO: 236517 - DNA, 26 bp, Artificial sequence
  SiRNA target sequence
gagagaaagatgttttggatcatggc

SEQ ID NO: 236518 - DNA, 26 bp, Artificial sequence
  SiRNA target sequence
agagaaagatgttttggatcatggca

SEQ ID NO: 236519 - DNA, 26 bp, Artificial sequence
  SiRNA target sequence
gagaaagatgttttggatcatggcag

SEQ ID NO: 236520 - DNA, 26 bp, Artificial sequence
  SiRNA target sequence
agaaagatgttttggatcatggcagc

SEQ ID NO: 236521 - DNA, 26 bp, Artificial sequence
  SiRNA target sequence
gaaagatgttttggatcatggcagct

SEQ ID NO: 236522 - DNA, 26 bp, Artificial sequence
  SiRNA target sequence
aaagatgttttggatcatggcagcta

SEQ ID NO: 236523 - DNA, 26 bp, Artificial sequence
  SiRNA target sequence
aagatgttttggatcatggcagctat

SEQ ID NO: 236524 - DNA, 26 bp, Artificial sequence
  SiRNA target sequence
agatgttttggatcatggcagctatg

SEQ ID NO: 236525 - DNA, 26 bp, Artificial sequence
  SiRNA target sequence
gatgttttggatcatggcagctatgt

SEQ ID NO: 236526 - DNA, 26 bp, Artificial sequence
  SiRNA target sequence
atgttttggatcatggcagctatgtt

SEQ ID NO: 236527 - DNA, 26 bp, Artificial sequence
  SiRNA target sequence
tgttttggatcatggcagctatgttc

SEQ ID NO: 236528 - DNA, 26 bp, Artificial sequence
  SiRNA target sequence
gttttggatcatggcagctatgttct

SEQ ID NO: 236529 - DNA, 26 bp, Artificial sequence
  SiRNA target sequence
ttttggatcatggcagctatgttctt

SEQ ID NO: 236530 - DNA, 26 bp, Artificial sequence
  SiRNA target sequence
tttggatcatggcagctatgttcttt

SEQ ID NO: 236531 - DNA, 26 bp, Artificial sequence
  SiRNA target sequence
ttggatcatggcagctatgttcttta

SEQ ID NO: 236532 - DNA, 26 bp, Artificial sequence
  SiRNA target sequence
tggatcatggcagctatgttctttat

SEQ ID NO: 236533 - DNA, 26 bp, Artificial sequence
  SiRNA target sequence
ggatcatggcagctatgttctttatt

SEQ ID NO: 236534 - DNA, 26 bp, Artificial sequence
  SiRNA target sequence
gatcatggcagctatgttctttatta

SEQ ID NO: 236535 - DNA, 26 bp, Artificial sequence
  SiRNA target sequence
atcatggcagctatgttctttattat

SEQ ID NO: 236536 - DNA, 26 bp, Artificial sequence
  SiRNA target sequence
tcatggcagctatgttctttattatc

SEQ ID NO: 236537 - DNA, 26 bp, Artificial sequence
  SiRNA target sequence
catggcagctatgttctttattatct

SEQ ID NO: 236538 - DNA, 26 bp, Artificial sequence
  SiRNA target sequence
atggcagctatgttctttattatctc

SEQ ID NO: 236539 - DNA, 26 bp, Artificial sequence
  SiRNA target sequence
tggcagctatgttctttattatctcc

SEQ ID NO: 236540 - DNA, 26 bp, Artificial sequence
  SiRNA target sequence
ggcagctatgttctttattatctcct

SEQ ID NO: 236541 - DNA, 26 bp, Artificial sequence
  SiRNA target sequence
gcagctatgttctttattatctcctt

SEQ ID NO: 236542 - DNA, 26 bp, Artificial sequence
  SiRNA target sequence
cagctatgttctttattatctccttt

SEQ ID NO: 236543 - DNA, 26 bp, Artificial sequence
  SiRNA target sequence
agctatgttctttattatctccttta

SEQ ID NO: 236544 - DNA, 26 bp, Artificial sequence
  SiRNA target sequence
gctatgttctttattatctcctttat

SEQ ID NO: 236545 - DNA, 26 bp, Artificial sequence
  SiRNA target sequence
ctatgttctttattatctcctttatt

SEQ ID NO: 236546 - DNA, 26 bp, Artificial sequence
  SiRNA target sequence
tatgttctttattatctcctttattt

SEQ ID NO: 236547 - DNA, 26 bp, Artificial sequence
  SiRNA target sequence
atgttctttattatctcctttattta

SEQ ID NO: 236548 - DNA, 26 bp, Artificial sequence
  SiRNA target sequence
tgttctttattatctcctttatttat

SEQ ID NO: 236549 - DNA, 26 bp, Artificial sequence
  SiRNA target sequence
gttctttattatctcctttatttatt

SEQ ID NO: 236550 - DNA, 26 bp, Artificial sequence
  SiRNA target sequence
ttctttattatctcctttatttattc

SEQ ID NO: 236551 - DNA, 26 bp, Artificial sequence
  SiRNA target sequence
tctttattatctcctttatttattcg

SEQ ID NO: 236552 - DNA, 26 bp, Artificial sequence
  SiRNA target sequence
ctttattatctcctttatttattcgg

SEQ ID NO: 236553 - DNA, 26 bp, Artificial sequence
  SiRNA target sequence
tttattatctcctttatttattcggt

SEQ ID NO: 236554 - DNA, 26 bp, Artificial sequence
  SiRNA target sequence
ttattatctcctttatttattcggtg

SEQ ID NO: 236555 - DNA, 26 bp, Artificial sequence
  SiRNA target sequence
tattatctcctttatttattcggtgg

SEQ ID NO: 236556 - DNA, 26 bp, Artificial sequence
  SiRNA target sequence
attatctcctttatttattcggtggc

SEQ ID NO: 236557 - DNA, 26 bp, Artificial sequence
  SiRNA target sequence
ttatctcctttatttattcggtggct

SEQ ID NO: 236558 - DNA, 26 bp, Artificial sequence
  SiRNA target sequence
tatctcctttatttattcggtggcta

SEQ ID NO: 236559 - DNA, 26 bp, Artificial sequence
  SiRNA target sequence
atctcctttatttattcggtggctag

SEQ ID NO: 236560 - DNA, 26 bp, Artificial sequence
  SiRNA target sequence
tctcctttatttattcggtggctaga

SEQ ID NO: 236561 - DNA, 26 bp, Artificial sequence
  SiRNA target sequence
ctcctttatttattcggtggctagag

SEQ ID NO: 236562 - DNA, 26 bp, Artificial sequence
  SiRNA target sequence
tcctttatttattcggtggctagagt

SEQ ID NO: 236563 - DNA, 26 bp, Artificial sequence
  SiRNA target sequence
cctttatttattcggtggctagagtg

SEQ ID NO: 236564 - DNA, 26 bp, Artificial sequence
  SiRNA target sequence
ctttatttattcggtggctagagtgc

SEQ ID NO: 236565 - DNA, 26 bp, Artificial sequence
  SiRNA target sequence
tttatttattcggtggctagagtgct

SEQ ID NO: 236566 - DNA, 26 bp, Artificial sequence
  SiRNA target sequence
ttatttattcggtggctagagtgctt

SEQ ID NO: 236567 - DNA, 26 bp, Artificial sequence
  SiRNA target sequence
tatttattcggtggctagagtgctta

SEQ ID NO: 236568 - DNA, 26 bp, Artificial sequence
  SiRNA target sequence
atttattcggtggctagagtgcttaa

SEQ ID NO: 236569 - DNA, 26 bp, Artificial sequence
  SiRNA target sequence
tttattcggtggctagagtgcttaaa

SEQ ID NO: 236570 - DNA, 26 bp, Artificial sequence
  SiRNA target sequence
ttattcggtggctagagtgcttaaag

SEQ ID NO: 236571 - DNA, 26 bp, Artificial sequence
  SiRNA target sequence
tattcggtggctagagtgcttaaaga

SEQ ID NO: 236572 - DNA, 26 bp, Artificial sequence
  SiRNA target sequence
attcggtggctagagtgcttaaagat

SEQ ID NO: 236573 - DNA, 26 bp, Artificial sequence
  SiRNA target sequence
ttcggtggctagagtgcttaaagatg

SEQ ID NO: 236574 - DNA, 26 bp, Artificial sequence
  SiRNA target sequence
tcggtggctagagtgcttaaagatgc

SEQ ID NO: 236575 - DNA, 26 bp, Artificial sequence
  SiRNA target sequence
cggtggctagagtgcttaaagatgcc

SEQ ID NO: 236576 - DNA, 26 bp, Artificial sequence
  SiRNA target sequence
ggtggctagagtgcttaaagatgccg

SEQ ID NO: 236577 - DNA, 26 bp, Artificial sequence
  SiRNA target sequence
gtggctagagtgcttaaagatgccgc

SEQ ID NO: 236578 - DNA, 26 bp, Artificial sequence
  SiRNA target sequence
tggctagagtgcttaaagatgccgct

SEQ ID NO: 236579 - DNA, 26 bp, Artificial sequence
  SiRNA target sequence
ggctagagtgcttaaagatgccgctg

SEQ ID NO: 236580 - DNA, 26 bp, Artificial sequence
  SiRNA target sequence
gctagagtgcttaaagatgccgctgt

SEQ ID NO: 236581 - DNA, 26 bp, Artificial sequence
  SiRNA target sequence
ctagagtgcttaaagatgccgctgtt

SEQ ID NO: 236582 - DNA, 26 bp, Artificial sequence
  SiRNA target sequence
tagagtgcttaaagatgccgctgtta

SEQ ID NO: 236583 - DNA, 26 bp, Artificial sequence
  SiRNA target sequence
agagtgcttaaagatgccgctgttat

SEQ ID NO: 236584 - DNA, 26 bp, Artificial sequence
  SiRNA target sequence
gagtgcttaaagatgccgctgttatt

SEQ ID NO: 236585 - DNA, 26 bp, Artificial sequence
  SiRNA target sequence
agtgcttaaagatgccgctgttattg

SEQ ID NO: 236586 - DNA, 26 bp, Artificial sequence
  SiRNA target sequence
gtgcttaaagatgccgctgttattgg

SEQ ID NO: 236587 - DNA, 26 bp, Artificial sequence
  SiRNA target sequence
tgcttaaagatgccgctgttattggt

SEQ ID NO: 236588 - DNA, 26 bp, Artificial sequence
  SiRNA target sequence
gcttaaagatgccgctgttattggta

SEQ ID NO: 236589 - DNA, 26 bp, Artificial sequence
  SiRNA target sequence
cttaaagatgccgctgttattggtaa

SEQ ID NO: 236590 - DNA, 26 bp, Artificial sequence
  SiRNA target sequence
ttaaagatgccgctgttattggtaaa

SEQ ID NO: 236591 - DNA, 26 bp, Artificial sequence
  SiRNA target sequence
taaagatgccgctgttattggtaaac

SEQ ID NO: 236592 - DNA, 26 bp, Artificial sequence
  SiRNA target sequence
aaagatgccgctgttattggtaaaca

SEQ ID NO: 236593 - DNA, 26 bp, Artificial sequence
  SiRNA target sequence
aagatgccgctgttattggtaaacaa

SEQ ID NO: 236594 - DNA, 26 bp, Artificial sequence
  SiRNA target sequence
agatgccgctgttattggtaaacaac

SEQ ID NO: 236595 - DNA, 26 bp, Artificial sequence
  SiRNA target sequence
gatgccgctgttattggtaaacaact

SEQ ID NO: 236596 - DNA, 26 bp, Artificial sequence
  SiRNA target sequence
atgccgctgttattggtaaacaactc

SEQ ID NO: 236597 - DNA, 26 bp, Artificial sequence
  SiRNA target sequence
tgccgctgttattggtaaacaactcc

SEQ ID NO: 236598 - DNA, 26 bp, Artificial sequence
  SiRNA target sequence
gccgctgttattggtaaacaactccc

SEQ ID NO: 236599 - DNA, 26 bp, Artificial sequence
  SiRNA target sequence
ccgctgttattggtaaacaactccca

SEQ ID NO: 236600 - DNA, 26 bp, Artificial sequence
  SiRNA target sequence
cgctgttattggtaaacaactcccag

SEQ ID NO: 236601 - DNA, 26 bp, Artificial sequence
  SiRNA target sequence
gctgttattggtaaacaactcccagc

SEQ ID NO: 236602 - DNA, 26 bp, Artificial sequence
  SiRNA target sequence
ctgttattggtaaacaactcccagcg

SEQ ID NO: 236603 - DNA, 26 bp, Artificial sequence
  SiRNA target sequence
tgttattggtaaacaactcccagcgt

SEQ ID NO: 236604 - DNA, 26 bp, Artificial sequence
  SiRNA target sequence
gttattggtaaacaactcccagcgtc

SEQ ID NO: 236605 - DNA, 26 bp, Artificial sequence
  SiRNA target sequence
ttattggtaaacaactcccagcgtca

SEQ ID NO: 236606 - DNA, 26 bp, Artificial sequence
  SiRNA target sequence
tattggtaaacaactcccagcgtcaa

SEQ ID NO: 236607 - DNA, 26 bp, Artificial sequence
  SiRNA target sequence
attggtaaacaactcccagcgtcaat

SEQ ID NO: 236608 - DNA, 26 bp, Artificial sequence
  SiRNA target sequence
ttggtaaacaactcccagcgtcaatt

SEQ ID NO: 236609 - DNA, 26 bp, Artificial sequence
  SiRNA target sequence
tggtaaacaactcccagcgtcaattt

SEQ ID NO: 236610 - DNA, 26 bp, Artificial sequence
  SiRNA target sequence
ggtaaacaactcccagcgtcaatttt

SEQ ID NO: 236611 - DNA, 26 bp, Artificial sequence
  SiRNA target sequence
gtaaacaactcccagcgtcaattttc

SEQ ID NO: 236612 - DNA, 26 bp, Artificial sequence
  SiRNA target sequence
taaacaactcccagcgtcaattttct

SEQ ID NO: 236613 - DNA, 26 bp, Artificial sequence
  SiRNA target sequence
aaacaactcccagcgtcaattttctt

SEQ ID NO: 236614 - DNA, 26 bp, Artificial sequence
  SiRNA target sequence
aacaactcccagcgtcaattttcttt

SEQ ID NO: 236615 - DNA, 26 bp, Artificial sequence
  SiRNA target sequence
acaactcccagcgtcaattttctttt

SEQ ID NO: 236616 - DNA, 26 bp, Artificial sequence
  SiRNA target sequence
caactcccagcgtcaattttcttttt

SEQ ID NO: 236617 - DNA, 26 bp, Artificial sequence
  SiRNA target sequence
aactcccagcgtcaattttctttttg

SEQ ID NO: 236618 - DNA, 26 bp, Artificial sequence
  SiRNA target sequence
actcccagcgtcaattttctttttga

SEQ ID NO: 236619 - DNA, 26 bp, Artificial sequence
  SiRNA target sequence
ctcccagcgtcaattttctttttgaa

SEQ ID NO: 236620 - DNA, 26 bp, Artificial sequence
  SiRNA target sequence
tcccagcgtcaattttctttttgaaa

SEQ ID NO: 236621 - DNA, 26 bp, Artificial sequence
  SiRNA target sequence
cccagcgtcaattttctttttgaaat

SEQ ID NO: 236622 - DNA, 26 bp, Artificial sequence
  SiRNA target sequence
ccagcgtcaattttctttttgaaatt

SEQ ID NO: 236623 - DNA, 26 bp, Artificial sequence
  SiRNA target sequence
cagcgtcaattttctttttgaaattt

SEQ ID NO: 236624 - DNA, 26 bp, Artificial sequence
  SiRNA target sequence
agcgtcaattttctttttgaaatttg

SEQ ID NO: 236625 - DNA, 26 bp, Artificial sequence
  SiRNA target sequence
gcgtcaattttctttttgaaatttgt

SEQ ID NO: 236626 - DNA, 26 bp, Artificial sequence
  SiRNA target sequence
cgtcaattttctttttgaaatttgtt

SEQ ID NO: 236627 - DNA, 26 bp, Artificial sequence
  SiRNA target sequence
gtcaattttctttttgaaatttgtta

SEQ ID NO: 236628 - DNA, 26 bp, Artificial sequence
  SiRNA target sequence
tcaattttctttttgaaatttgttat

SEQ ID NO: 236629 - DNA, 26 bp, Artificial sequence
  SiRNA target sequence
caattttctttttgaaatttgttatt

SEQ ID NO: 236630 - DNA, 26 bp, Artificial sequence
  SiRNA target sequence
aattttctttttgaaatttgttatta

SEQ ID NO: 236631 - DNA, 26 bp, Artificial sequence
  SiRNA target sequence
attttctttttgaaatttgttattat

SEQ ID NO: 236632 - DNA, 26 bp, Artificial sequence
  SiRNA target sequence
ttttctttttgaaatttgttattatc

SEQ ID NO: 236633 - DNA, 26 bp, Artificial sequence
  SiRNA target sequence
tttctttttgaaatttgttattatcc

SEQ ID NO: 236634 - DNA, 26 bp, Artificial sequence
  SiRNA target sequence
ttctttttgaaatttgttattatcct

SEQ ID NO: 236635 - DNA, 26 bp, Artificial sequence
  SiRNA target sequence
tctttttgaaatttgttattatcctt

SEQ ID NO: 236636 - DNA, 26 bp, Artificial sequence
  SiRNA target sequence
ctttttgaaatttgttattatccttc

SEQ ID NO: 236637 - DNA, 26 bp, Artificial sequence
  SiRNA target sequence
tttttgaaatttgttattatccttcc

SEQ ID NO: 236638 - DNA, 26 bp, Artificial sequence
  SiRNA target sequence
ttttgaaatttgttattatccttccg

SEQ ID NO: 236639 - DNA, 26 bp, Artificial sequence
  SiRNA target sequence
tttgaaatttgttattatccttccgt

SEQ ID NO: 236640 - DNA, 26 bp, Artificial sequence
  SiRNA target sequence
ttgaaatttgttattatccttccgtt

SEQ ID NO: 236641 - DNA, 26 bp, Artificial sequence
  SiRNA target sequence
tgaaatttgttattatccttccgttc

SEQ ID NO: 236642 - DNA, 26 bp, Artificial sequence
  SiRNA target sequence
gaaatttgttattatccttccgttct

SEQ ID NO: 236643 - DNA, 26 bp, Artificial sequence
  SiRNA target sequence
aaatttgttattatccttccgttctc

SEQ ID NO: 236644 - DNA, 26 bp, Artificial sequence
  SiRNA target sequence
aatttgttattatccttccgttctca

SEQ ID NO: 236645 - DNA, 26 bp, Artificial sequence
  SiRNA target sequence
atttgttattatccttccgttctcat

SEQ ID NO: 236646 - DNA, 26 bp, Artificial sequence
  SiRNA target sequence
tttgttattatccttccgttctcatt

SEQ ID NO: 236647 - DNA, 26 bp, Artificial sequence
  SiRNA target sequence
ttgttattatccttccgttctcattt

SEQ ID NO: 236648 - DNA, 26 bp, Artificial sequence
  SiRNA target sequence
tgttattatccttccgttctcattta

SEQ ID NO: 236649 - DNA, 26 bp, Artificial sequence
  SiRNA target sequence
gttattatccttccgttctcatttat

SEQ ID NO: 236650 - DNA, 26 bp, Artificial sequence
  SiRNA target sequence
ttattatccttccgttctcatttatt

SEQ ID NO: 236651 - DNA, 26 bp, Artificial sequence
  SiRNA target sequence
tattatccttccgttctcatttattt

SEQ ID NO: 236652 - DNA, 26 bp, Artificial sequence
  SiRNA target sequence
attatccttccgttctcatttatttc

SEQ ID NO: 236653 - DNA, 26 bp, Artificial sequence
  SiRNA target sequence
ttatccttccgttctcatttatttca

SEQ ID NO: 236654 - DNA, 26 bp, Artificial sequence
  SiRNA target sequence
tatccttccgttctcatttatttcag

SEQ ID NO: 236655 - DNA, 26 bp, Artificial sequence
  SiRNA target sequence
atccttccgttctcatttatttcagt

SEQ ID NO: 236656 - DNA, 26 bp, Artificial sequence
  SiRNA target sequence
tccttccgttctcatttatttcagta

SEQ ID NO: 236657 - DNA, 26 bp, Artificial sequence
  SiRNA target sequence
ccttccgttctcatttatttcagtag

SEQ ID NO: 236658 - DNA, 26 bp, Artificial sequence
  SiRNA target sequence
cttccgttctcatttatttcagtagg

SEQ ID NO: 236659 - DNA, 26 bp, Artificial sequence
  SiRNA target sequence
ttccgttctcatttatttcagtaggt

SEQ ID NO: 236660 - DNA, 26 bp, Artificial sequence
  SiRNA target sequence
tccgttctcatttatttcagtaggta

SEQ ID NO: 236661 - DNA, 26 bp, Artificial sequence
  SiRNA target sequence
ccgttctcatttatttcagtaggtat

SEQ ID NO: 236662 - DNA, 26 bp, Artificial sequence
  SiRNA target sequence
cgttctcatttatttcagtaggtatt

SEQ ID NO: 236663 - DNA, 26 bp, Artificial sequence
  SiRNA target sequence
gttctcatttatttcagtaggtatta

SEQ ID NO: 236664 - DNA, 26 bp, Artificial sequence
  SiRNA target sequence
ttctcatttatttcagtaggtattat

SEQ ID NO: 236665 - DNA, 26 bp, Artificial sequence
  SiRNA target sequence
tctcatttatttcagtaggtattatt

SEQ ID NO: 236666 - DNA, 26 bp, Artificial sequence
  SiRNA target sequence
ctcatttatttcagtaggtattattc

SEQ ID NO: 236667 - DNA, 26 bp, Artificial sequence
  SiRNA target sequence
tcatttatttcagtaggtattattca

SEQ ID NO: 236668 - DNA, 26 bp, Artificial sequence
  SiRNA target sequence
catttatttcagtaggtattattcag

SEQ ID NO: 236669 - DNA, 26 bp, Artificial sequence
  SiRNA target sequence
atttatttcagtaggtattattcaga

SEQ ID NO: 236670 - DNA, 26 bp, Artificial sequence
  SiRNA target sequence
tttatttcagtaggtattattcagaa

SEQ ID NO: 236671 - DNA, 26 bp, Artificial sequence
  SiRNA target sequence
ttatttcagtaggtattattcagaaa

SEQ ID NO: 236672 - DNA, 26 bp, Artificial sequence
  SiRNA target sequence
tatttcagtaggtattattcagaaag

SEQ ID NO: 236673 - DNA, 26 bp, Artificial sequence
  SiRNA target sequence
atttcagtaggtattattcagaaagc

SEQ ID NO: 236674 - DNA, 26 bp, Artificial sequence
  SiRNA target sequence
tttcagtaggtattattcagaaagct

SEQ ID NO: 236675 - DNA, 26 bp, Artificial sequence
  SiRNA target sequence
ttcagtaggtattattcagaaagctt

SEQ ID NO: 236676 - DNA, 26 bp, Artificial sequence
  SiRNA target sequence
tcagtaggtattattcagaaagcttt

SEQ ID NO: 236677 - DNA, 26 bp, Artificial sequence
  SiRNA target sequence
cagtaggtattattcagaaagcttta

SEQ ID NO: 236678 - DNA, 26 bp, Artificial sequence
  SiRNA target sequence
agtaggtattattcagaaagctttag

SEQ ID NO: 236679 - DNA, 26 bp, Artificial sequence
  SiRNA target sequence
gtaggtattattcagaaagctttaga

SEQ ID NO: 236680 - DNA, 26 bp, Artificial sequence
  SiRNA target sequence
taggtattattcagaaagctttagat

SEQ ID NO: 236681 - DNA, 26 bp, Artificial sequence
  SiRNA target sequence
aggtattattcagaaagctttagata

SEQ ID NO: 236682 - DNA, 26 bp, Artificial sequence
  SiRNA target sequence
ggtattattcagaaagctttagataa

SEQ ID NO: 236683 - DNA, 26 bp, Artificial sequence
  SiRNA target sequence
gtattattcagaaagctttagataaa

SEQ ID NO: 236684 - DNA, 26 bp, Artificial sequence
  SiRNA target sequence
tattattcagaaagctttagataaat

SEQ ID NO: 236685 - DNA, 26 bp, Artificial sequence
  SiRNA target sequence
attattcagaaagctttagataaata

SEQ ID NO: 236686 - DNA, 26 bp, Artificial sequence
  SiRNA target sequence
ttattcagaaagctttagataaatat

SEQ ID NO: 236687 - DNA, 26 bp, Artificial sequence
  SiRNA target sequence
tattcagaaagctttagataaatatc

SEQ ID NO: 236688 - DNA, 26 bp, Artificial sequence
  SiRNA target sequence
attcagaaagctttagataaatatcc

SEQ ID NO: 236689 - DNA, 26 bp, Artificial sequence
  SiRNA target sequence
ttcagaaagctttagataaatatcct

SEQ ID NO: 236690 - DNA, 26 bp, Artificial sequence
  SiRNA target sequence
tcagaaagctttagataaatatcctt

SEQ ID NO: 236691 - DNA, 26 bp, Artificial sequence
  SiRNA target sequence
cagaaagctttagataaatatccttt

SEQ ID NO: 236692 - DNA, 26 bp, Artificial sequence
  SiRNA target sequence
agaaagctttagataaatatcctttt

SEQ ID NO: 236693 - DNA, 26 bp, Artificial sequence
  SiRNA target sequence
gaaagctttagataaatatcctttta

SEQ ID NO: 236694 - DNA, 26 bp, Artificial sequence
  SiRNA target sequence
aaagctttagataaatatccttttac

SEQ ID NO: 236695 - DNA, 26 bp, Artificial sequence
  SiRNA target sequence
aagctttagataaatatccttttaca

SEQ ID NO: 236696 - DNA, 26 bp, Artificial sequence
  SiRNA target sequence
agctttagataaatatccttttacaa

SEQ ID NO: 236697 - DNA, 26 bp, Artificial sequence
  SiRNA target sequence
gctttagataaatatccttttacaaa

SEQ ID NO: 236698 - DNA, 26 bp, Artificial sequence
  SiRNA target sequence
ctttagataaatatccttttacaaaa

SEQ ID NO: 236699 - DNA, 26 bp, Artificial sequence
  SiRNA target sequence
tttagataaatatccttttacaaaaa

SEQ ID NO: 236700 - DNA, 26 bp, Artificial sequence
  SiRNA target sequence
ttagataaatatccttttacaaaaat

SEQ ID NO: 236701 - DNA, 26 bp, Artificial sequence
  SiRNA target sequence
tagataaatatccttttacaaaaata

SEQ ID NO: 236702 - DNA, 26 bp, Artificial sequence
  SiRNA target sequence
agataaatatccttttacaaaaatat

SEQ ID NO: 236703 - DNA, 26 bp, Artificial sequence
  SiRNA target sequence
gataaatatccttttacaaaaatatt

SEQ ID NO: 236704 - DNA, 26 bp, Artificial sequence
  SiRNA target sequence
ataaatatccttttacaaaaatattt

SEQ ID NO: 236705 - DNA, 26 bp, Artificial sequence
  SiRNA target sequence
taaatatccttttacaaaaatatttg

SEQ ID NO: 236706 - DNA, 26 bp, Artificial sequence
  SiRNA target sequence
aaatatccttttacaaaaatatttga

SEQ ID NO: 236707 - DNA, 26 bp, Artificial sequence
  SiRNA target sequence
aatatccttttacaaaaatatttgat

SEQ ID NO: 236708 - DNA, 26 bp, Artificial sequence
  SiRNA target sequence
atatccttttacaaaaatatttgatg

SEQ ID NO: 236709 - DNA, 26 bp, Artificial sequence
  SiRNA target sequence
tatccttttacaaaaatatttgatgt

SEQ ID NO: 236710 - DNA, 26 bp, Artificial sequence
  SiRNA target sequence
atccttttacaaaaatatttgatgta

SEQ ID NO: 236711 - DNA, 26 bp, Artificial sequence
  SiRNA target sequence
tccttttacaaaaatatttgatgtaa

SEQ ID NO: 236712 - DNA, 26 bp, Artificial sequence
  SiRNA target sequence
ccttttacaaaaatatttgatgtaac

SEQ ID NO: 236713 - DNA, 26 bp, Artificial sequence
  SiRNA target sequence
cttttacaaaaatatttgatgtaact

SEQ ID NO: 236714 - DNA, 26 bp, Artificial sequence
  SiRNA target sequence
ttttacaaaaatatttgatgtaactt

SEQ ID NO: 236715 - DNA, 26 bp, Artificial sequence
  SiRNA target sequence
tttacaaaaatatttgatgtaacttt

SEQ ID NO: 236716 - DNA, 26 bp, Artificial sequence
  SiRNA target sequence
ttacaaaaatatttgatgtaacttta

SEQ ID NO: 236717 - DNA, 26 bp, Artificial sequence
  SiRNA target sequence
tacaaaaatatttgatgtaactttaa

SEQ ID NO: 236718 - DNA, 26 bp, Artificial sequence
  SiRNA target sequence
acaaaaatatttgatgtaactttaat

SEQ ID NO: 236719 - DNA, 26 bp, Artificial sequence
  SiRNA target sequence
caaaaatatttgatgtaactttaata

SEQ ID NO: 236720 - DNA, 26 bp, Artificial sequence
  SiRNA target sequence
aaaaatatttgatgtaactttaatag

SEQ ID NO: 236721 - DNA, 26 bp, Artificial sequence
  SiRNA target sequence
aaaatatttgatgtaactttaatagt

SEQ ID NO: 236722 - DNA, 26 bp, Artificial sequence
  SiRNA target sequence
aaatatttgatgtaactttaatagtt

SEQ ID NO: 236723 - DNA, 26 bp, Artificial sequence
  SiRNA target sequence
aatatttgatgtaactttaatagttt

SEQ ID NO: 236724 - DNA, 26 bp, Artificial sequence
  SiRNA target sequence
atatttgatgtaactttaatagtttt

SEQ ID NO: 236725 - DNA, 26 bp, Artificial sequence
  SiRNA target sequence
tatttgatgtaactttaatagttttc

SEQ ID NO: 236726 - DNA, 26 bp, Artificial sequence
  SiRNA target sequence
atttgatgtaactttaatagttttcg

SEQ ID NO: 236727 - DNA, 26 bp, Artificial sequence
  SiRNA target sequence
tttgatgtaactttaatagttttcgc

SEQ ID NO: 236728 - DNA, 26 bp, Artificial sequence
  SiRNA target sequence
ttgatgtaactttaatagttttcgct

SEQ ID NO: 236729 - DNA, 26 bp, Artificial sequence
  SiRNA target sequence
tgatgtaactttaatagttttcgctg

SEQ ID NO: 236730 - DNA, 26 bp, Artificial sequence
  SiRNA target sequence
gatgtaactttaatagttttcgctgt

SEQ ID NO: 236731 - DNA, 26 bp, Artificial sequence
  SiRNA target sequence
atgtaactttaatagttttcgctgtt

SEQ ID NO: 236732 - DNA, 26 bp, Artificial sequence
  SiRNA target sequence
tgtaactttaatagttttcgctgttg

SEQ ID NO: 236733 - DNA, 26 bp, Artificial sequence
  SiRNA target sequence
gtaactttaatagttttcgctgttgc

SEQ ID NO: 236734 - DNA, 26 bp, Artificial sequence
  SiRNA target sequence
taactttaatagttttcgctgttgca

SEQ ID NO: 236735 - DNA, 26 bp, Artificial sequence
  SiRNA target sequence
aactttaatagttttcgctgttgcat

SEQ ID NO: 236736 - DNA, 26 bp, Artificial sequence
  SiRNA target sequence
actttaatagttttcgctgttgcatt

SEQ ID NO: 236737 - DNA, 26 bp, Artificial sequence
  SiRNA target sequence
ctttaatagttttcgctgttgcattt

SEQ ID NO: 236738 - DNA, 26 bp, Artificial sequence
  SiRNA target sequence
tttaatagttttcgctgttgcattta

SEQ ID NO: 236739 - DNA, 26 bp, Artificial sequence
  SiRNA target sequence
ttaatagttttcgctgttgcatttac

SEQ ID NO: 236740 - DNA, 26 bp, Artificial sequence
  SiRNA target sequence
taatagttttcgctgttgcatttact

SEQ ID NO: 236741 - DNA, 26 bp, Artificial sequence
  SiRNA target sequence
aatagttttcgctgttgcatttacta

SEQ ID NO: 236742 - DNA, 26 bp, Artificial sequence
  SiRNA target sequence
atagttttcgctgttgcatttactat

SEQ ID NO: 236743 - DNA, 26 bp, Artificial sequence
  SiRNA target sequence
tagttttcgctgttgcatttactata

SEQ ID NO: 236744 - DNA, 26 bp, Artificial sequence
  SiRNA target sequence
agttttcgctgttgcatttactatac

SEQ ID NO: 236745 - DNA, 26 bp, Artificial sequence
  SiRNA target sequence
gttttcgctgttgcatttactatact

SEQ ID NO: 236746 - DNA, 26 bp, Artificial sequence
  SiRNA target sequence
ttttcgctgttgcatttactatactt

SEQ ID NO: 236747 - DNA, 26 bp, Artificial sequence
  SiRNA target sequence
tttcgctgttgcatttactatacttg

SEQ ID NO: 236748 - DNA, 26 bp, Artificial sequence
  SiRNA target sequence
ttcgctgttgcatttactatacttgg

SEQ ID NO: 236749 - DNA, 26 bp, Artificial sequence
  SiRNA target sequence
tcgctgttgcatttactatacttggt

SEQ ID NO: 236750 - DNA, 26 bp, Artificial sequence
  SiRNA target sequence
cgctgttgcatttactatacttggta

SEQ ID NO: 236751 - DNA, 26 bp, Artificial sequence
  SiRNA target sequence
gctgttgcatttactatacttggtag

SEQ ID NO: 236752 - DNA, 26 bp, Artificial sequence
  SiRNA target sequence
ctgttgcatttactatacttggtagt

SEQ ID NO: 236753 - DNA, 26 bp, Artificial sequence
  SiRNA target sequence
tgttgcatttactatacttggtagtt

SEQ ID NO: 236754 - DNA, 26 bp, Artificial sequence
  SiRNA target sequence
gttgcatttactatacttggtagttt

SEQ ID NO: 236755 - DNA, 26 bp, Artificial sequence
  SiRNA target sequence
ttgcatttactatacttggtagttta

SEQ ID NO: 236756 - DNA, 26 bp, Artificial sequence
  SiRNA target sequence
tgcatttactatacttggtagtttat

SEQ ID NO: 236757 - DNA, 26 bp, Artificial sequence
  SiRNA target sequence
gcatttactatacttggtagtttatt

SEQ ID NO: 236758 - DNA, 26 bp, Artificial sequence
  SiRNA target sequence
catttactatacttggtagtttatta

SEQ ID NO: 236759 - DNA, 26 bp, Artificial sequence
  SiRNA target sequence
atttactatacttggtagtttattac

SEQ ID NO: 236760 - DNA, 26 bp, Artificial sequence
  SiRNA target sequence
tttactatacttggtagtttattact

SEQ ID NO: 236761 - DNA, 26 bp, Artificial sequence
  SiRNA target sequence
ttactatacttggtagtttattactt

SEQ ID NO: 236762 - DNA, 26 bp, Artificial sequence
  SiRNA target sequence
tactatacttggtagtttattacttc

SEQ ID NO: 236763 - DNA, 26 bp, Artificial sequence
  SiRNA target sequence
actatacttggtagtttattacttcc

SEQ ID NO: 236764 - DNA, 26 bp, Artificial sequence
  SiRNA target sequence
ctatacttggtagtttattacttccc

SEQ ID NO: 236765 - DNA, 26 bp, Artificial sequence
  SiRNA target sequence
tatacttggtagtttattacttccct

SEQ ID NO: 236766 - DNA, 26 bp, Artificial sequence
  SiRNA target sequence
atacttggtagtttattacttccctt

SEQ ID NO: 236767 - DNA, 26 bp, Artificial sequence
  SiRNA target sequence
tacttggtagtttattacttcccttt

SEQ ID NO: 236768 - DNA, 26 bp, Artificial sequence
  SiRNA target sequence
acttggtagtttattacttcccttta

SEQ ID NO: 236769 - DNA, 26 bp, Artificial sequence
  SiRNA target sequence
cttggtagtttattacttccctttag

SEQ ID NO: 236770 - DNA, 26 bp, Artificial sequence
  SiRNA target sequence
ttggtagtttattacttccctttagt

SEQ ID NO: 236771 - DNA, 26 bp, Artificial sequence
  SiRNA target sequence
tggtagtttattacttccctttagtg

SEQ ID NO: 236772 - DNA, 26 bp, Artificial sequence
  SiRNA target sequence
ggtagtttattacttccctttagtga

SEQ ID NO: 236773 - DNA, 26 bp, Artificial sequence
  SiRNA target sequence
gtagtttattacttccctttagtgat

SEQ ID NO: 236774 - DNA, 26 bp, Artificial sequence
  SiRNA target sequence
tagtttattacttccctttagtgatt

SEQ ID NO: 236775 - DNA, 26 bp, Artificial sequence
  SiRNA target sequence
agtttattacttccctttagtgatta

SEQ ID NO: 236776 - DNA, 26 bp, Artificial sequence
  SiRNA target sequence
gtttattacttccctttagtgattat

SEQ ID NO: 236777 - DNA, 26 bp, Artificial sequence
  SiRNA target sequence
tttattacttccctttagtgattata

SEQ ID NO: 236778 - DNA, 26 bp, Artificial sequence
  SiRNA target sequence
ttattacttccctttagtgattatat

SEQ ID NO: 236779 - DNA, 26 bp, Artificial sequence
  SiRNA target sequence
tattacttccctttagtgattatatt

SEQ ID NO: 236780 - DNA, 26 bp, Artificial sequence
  SiRNA target sequence
attacttccctttagtgattatattc

SEQ ID NO: 236781 - DNA, 26 bp, Artificial sequence
  SiRNA target sequence
ttacttccctttagtgattatattca

SEQ ID NO: 236782 - DNA, 26 bp, Artificial sequence
  SiRNA target sequence
tacttccctttagtgattatattcag

SEQ ID NO: 236783 - DNA, 26 bp, Artificial sequence
  SiRNA target sequence
acttccctttagtgattatattcaga

SEQ ID NO: 236784 - DNA, 26 bp, Artificial sequence
  SiRNA target sequence
cttccctttagtgattatattcagat

SEQ ID NO: 236785 - DNA, 26 bp, Artificial sequence
  SiRNA target sequence
ttccctttagtgattatattcagatt

SEQ ID NO: 236786 - DNA, 26 bp, Artificial sequence
  SiRNA target sequence
tccctttagtgattatattcagattc

SEQ ID NO: 236787 - DNA, 26 bp, Artificial sequence
  SiRNA target sequence
ccctttagtgattatattcagattca

SEQ ID NO: 236788 - DNA, 26 bp, Artificial sequence
  SiRNA target sequence
cctttagtgattatattcagattcaa

SEQ ID NO: 236789 - DNA, 26 bp, Artificial sequence
  SiRNA target sequence
ctttagtgattatattcagattcaac

SEQ ID NO: 236790 - DNA, 26 bp, Artificial sequence
  SiRNA target sequence
tttagtgattatattcagattcaacc

SEQ ID NO: 236791 - DNA, 26 bp, Artificial sequence
  SiRNA target sequence
ttagtgattatattcagattcaaccg

SEQ ID NO: 236792 - DNA, 26 bp, Artificial sequence
  SiRNA target sequence
tagtgattatattcagattcaaccgt

SEQ ID NO: 236793 - DNA, 26 bp, Artificial sequence
  SiRNA target sequence
agtgattatattcagattcaaccgtt

SEQ ID NO: 236794 - DNA, 26 bp, Artificial sequence
  SiRNA target sequence
gtgattatattcagattcaaccgttt

SEQ ID NO: 236795 - DNA, 26 bp, Artificial sequence
  SiRNA target sequence
tgattatattcagattcaaccgtttt

SEQ ID NO: 236796 - DNA, 26 bp, Artificial sequence
  SiRNA target sequence
gattatattcagattcaaccgttttg

SEQ ID NO: 236797 - DNA, 26 bp, Artificial sequence
  SiRNA target sequence
attatattcagattcaaccgttttgg

SEQ ID NO: 236798 - DNA, 26 bp, Artificial sequence
  SiRNA target sequence
ttatattcagattcaaccgttttggg

SEQ ID NO: 236799 - DNA, 26 bp, Artificial sequence
  SiRNA target sequence
tatattcagattcaaccgttttgggc

SEQ ID NO: 236800 - DNA, 26 bp, Artificial sequence
  SiRNA target sequence
atattcagattcaaccgttttgggcc

SEQ ID NO: 236801 - DNA, 26 bp, Artificial sequence
  SiRNA target sequence
tattcagattcaaccgttttgggcca

SEQ ID NO: 236802 - DNA, 26 bp, Artificial sequence
  SiRNA target sequence
attcagattcaaccgttttgggccaa

SEQ ID NO: 236803 - DNA, 26 bp, Artificial sequence
  SiRNA target sequence
ttcagattcaaccgttttgggccaaa

SEQ ID NO: 236804 - DNA, 26 bp, Artificial sequence
  SiRNA target sequence
tcagattcaaccgttttgggccaaag

SEQ ID NO: 236805 - DNA, 26 bp, Artificial sequence
  SiRNA target sequence
cagattcaaccgttttgggccaaaga

SEQ ID NO: 236806 - DNA, 26 bp, Artificial sequence
  SiRNA target sequence
agattcaaccgttttgggccaaagat

SEQ ID NO: 236807 - DNA, 26 bp, Artificial sequence
  SiRNA target sequence
gattcaaccgttttgggccaaagata

SEQ ID NO: 236808 - DNA, 26 bp, Artificial sequence
  SiRNA target sequence
attcaaccgttttgggccaaagatat

SEQ ID NO: 236809 - DNA, 26 bp, Artificial sequence
  SiRNA target sequence
ttcaaccgttttgggccaaagatatt

SEQ ID NO: 236810 - DNA, 26 bp, Artificial sequence
  SiRNA target sequence
tcaaccgttttgggccaaagatattt

SEQ ID NO: 236811 - DNA, 26 bp, Artificial sequence
  SiRNA target sequence
caaccgttttgggccaaagatatttt

SEQ ID NO: 236812 - DNA, 26 bp, Artificial sequence
  SiRNA target sequence
aaccgttttgggccaaagatattttt

SEQ ID NO: 236813 - DNA, 26 bp, Artificial sequence
  SiRNA target sequence
accgttttgggccaaagatatttttg

SEQ ID NO: 236814 - DNA, 26 bp, Artificial sequence
  SiRNA target sequence
ccgttttgggccaaagatatttttgc

SEQ ID NO: 236815 - DNA, 26 bp, Artificial sequence
  SiRNA target sequence
cgttttgggccaaagatatttttgct

SEQ ID NO: 236816 - DNA, 26 bp, Artificial sequence
  SiRNA target sequence
gttttgggccaaagatatttttgctg

SEQ ID NO: 236817 - DNA, 26 bp, Artificial sequence
  SiRNA target sequence
ttttgggccaaagatatttttgctga

SEQ ID NO: 236818 - DNA, 26 bp, Artificial sequence
  SiRNA target sequence
tttgggccaaagatatttttgctgat

SEQ ID NO: 236819 - DNA, 26 bp, Artificial sequence
  SiRNA target sequence
ttgggccaaagatatttttgctgatg

SEQ ID NO: 236820 - DNA, 26 bp, Artificial sequence
  SiRNA target sequence
tgggccaaagatatttttgctgatgg

SEQ ID NO: 236821 - DNA, 26 bp, Artificial sequence
  SiRNA target sequence
gggccaaagatatttttgctgatgga

SEQ ID NO: 236822 - DNA, 26 bp, Artificial sequence
  SiRNA target sequence
ggccaaagatatttttgctgatggaa

SEQ ID NO: 236823 - DNA, 26 bp, Artificial sequence
  SiRNA target sequence
gccaaagatatttttgctgatggaaa

SEQ ID NO: 236824 - DNA, 26 bp, Artificial sequence
  SiRNA target sequence
ccaaagatatttttgctgatggaaaa

SEQ ID NO: 236825 - DNA, 26 bp, Artificial sequence
  SiRNA target sequence
caaagatatttttgctgatggaaaag

SEQ ID NO: 236826 - DNA, 26 bp, Artificial sequence
  SiRNA target sequence
aaagatatttttgctgatggaaaagc

SEQ ID NO: 236827 - DNA, 26 bp, Artificial sequence
  SiRNA target sequence
aagatatttttgctgatggaaaagct

SEQ ID NO: 236828 - DNA, 26 bp, Artificial sequence
  SiRNA target sequence
agatatttttgctgatggaaaagctg

SEQ ID NO: 236829 - DNA, 26 bp, Artificial sequence
  SiRNA target sequence
gatatttttgctgatggaaaagctgt

SEQ ID NO: 236830 - DNA, 26 bp, Artificial sequence
  SiRNA target sequence
atatttttgctgatggaaaagctgtt

SEQ ID NO: 236831 - DNA, 26 bp, Artificial sequence
  SiRNA target sequence
tatttttgctgatggaaaagctgttg

SEQ ID NO: 236832 - DNA, 26 bp, Artificial sequence
  SiRNA target sequence
atttttgctgatggaaaagctgttgc

SEQ ID NO: 236833 - DNA, 26 bp, Artificial sequence
  SiRNA target sequence
tttttgctgatggaaaagctgttgcc

SEQ ID NO: 236834 - DNA, 26 bp, Artificial sequence
  SiRNA target sequence
ttttgctgatggaaaagctgttgcca

SEQ ID NO: 236835 - DNA, 26 bp, Artificial sequence
  SiRNA target sequence
tttgctgatggaaaagctgttgccag

SEQ ID NO: 236836 - DNA, 26 bp, Artificial sequence
  SiRNA target sequence
ttgctgatggaaaagctgttgccaga

SEQ ID NO: 236837 - DNA, 26 bp, Artificial sequence
  SiRNA target sequence
tgctgatggaaaagctgttgccagaa

SEQ ID NO: 236838 - DNA, 26 bp, Artificial sequence
  SiRNA target sequence
gctgatggaaaagctgttgccagaag

SEQ ID NO: 236839 - DNA, 26 bp, Artificial sequence
  SiRNA target sequence
ctgatggaaaagctgttgccagaagt

SEQ ID NO: 236840 - DNA, 26 bp, Artificial sequence
  SiRNA target sequence
tgatggaaaagctgttgccagaagta

SEQ ID NO: 236841 - DNA, 26 bp, Artificial sequence
  SiRNA target sequence
gatggaaaagctgttgccagaagtac

SEQ ID NO: 236842 - DNA, 26 bp, Artificial sequence
  SiRNA target sequence
atggaaaagctgttgccagaagtaca

SEQ ID NO: 236843 - DNA, 26 bp, Artificial sequence
  SiRNA target sequence
tggaaaagctgttgccagaagtacag

SEQ ID NO: 236844 - DNA, 26 bp, Artificial sequence
  SiRNA target sequence
ggaaaagctgttgccagaagtacaga

SEQ ID NO: 236845 - DNA, 26 bp, Artificial sequence
  SiRNA target sequence
gaaaagctgttgccagaagtacagat

SEQ ID NO: 236846 - DNA, 26 bp, Artificial sequence
  SiRNA target sequence
aaaagctgttgccagaagtacagatt

SEQ ID NO: 236847 - DNA, 26 bp, Artificial sequence
  SiRNA target sequence
aaagctgttgccagaagtacagattt

SEQ ID NO: 236848 - DNA, 26 bp, Artificial sequence
  SiRNA target sequence
aagctgttgccagaagtacagatttt

SEQ ID NO: 236849 - DNA, 26 bp, Artificial sequence
  SiRNA target sequence
agctgttgccagaagtacagattttt

SEQ ID NO: 236850 - DNA, 26 bp, Artificial sequence
  SiRNA target sequence
gctgttgccagaagtacagatttttt

SEQ ID NO: 236851 - DNA, 26 bp, Artificial sequence
  SiRNA target sequence
ctgttgccagaagtacagatttttta

SEQ ID NO: 236852 - DNA, 26 bp, Artificial sequence
  SiRNA target sequence
tgttgccagaagtacagattttttat

SEQ ID NO: 236853 - DNA, 26 bp, Artificial sequence
  SiRNA target sequence
gttgccagaagtacagattttttatt

SEQ ID NO: 236854 - DNA, 26 bp, Artificial sequence
  SiRNA target sequence
ttgccagaagtacagattttttattt

SEQ ID NO: 236855 - DNA, 26 bp, Artificial sequence
  SiRNA target sequence
tgccagaagtacagattttttatttt

SEQ ID NO: 236856 - DNA, 26 bp, Artificial sequence
  SiRNA target sequence
gccagaagtacagattttttattttc

SEQ ID NO: 236857 - DNA, 26 bp, Artificial sequence
  SiRNA target sequence
ccagaagtacagattttttattttct

SEQ ID NO: 236858 - DNA, 26 bp, Artificial sequence
  SiRNA target sequence
cagaagtacagattttttattttcta

SEQ ID NO: 236859 - DNA, 26 bp, Artificial sequence
  SiRNA target sequence
agaagtacagattttttattttctat

SEQ ID NO: 236860 - DNA, 26 bp, Artificial sequence
  SiRNA target sequence
gaagtacagattttttattttctatt

SEQ ID NO: 236861 - DNA, 26 bp, Artificial sequence
  SiRNA target sequence
aagtacagattttttattttctattg

SEQ ID NO: 236862 - DNA, 26 bp, Artificial sequence
  SiRNA target sequence
agtacagattttttattttctattgc

SEQ ID NO: 236863 - DNA, 26 bp, Artificial sequence
  SiRNA target sequence
gtacagattttttattttctattgca

SEQ ID NO: 236864 - DNA, 26 bp, Artificial sequence
  SiRNA target sequence
tacagattttttattttctattgcac

SEQ ID NO: 236865 - DNA, 26 bp, Artificial sequence
  SiRNA target sequence
acagattttttattttctattgcact

SEQ ID NO: 236866 - DNA, 26 bp, Artificial sequence
  SiRNA target sequence
cagattttttattttctattgcactt

SEQ ID NO: 236867 - DNA, 26 bp, Artificial sequence
  SiRNA target sequence
agattttttattttctattgcacttg

SEQ ID NO: 236868 - DNA, 26 bp, Artificial sequence
  SiRNA target sequence
gattttttattttctattgcacttgt

SEQ ID NO: 236869 - DNA, 26 bp, Artificial sequence
  SiRNA target sequence
attttttattttctattgcacttgtt

SEQ ID NO: 236870 - DNA, 26 bp, Artificial sequence
  SiRNA target sequence
ttttttattttctattgcacttgttt

SEQ ID NO: 236871 - DNA, 26 bp, Artificial sequence
  SiRNA target sequence
tttttattttctattgcacttgtttt

SEQ ID NO: 236872 - DNA, 26 bp, Artificial sequence
  SiRNA target sequence
ttttattttctattgcacttgttttc

SEQ ID NO: 236873 - DNA, 26 bp, Artificial sequence
  SiRNA target sequence
tttattttctattgcacttgttttca

SEQ ID NO: 236874 - DNA, 26 bp, Artificial sequence
  SiRNA target sequence
ttattttctattgcacttgttttcaa

SEQ ID NO: 236875 - DNA, 26 bp, Artificial sequence
  SiRNA target sequence
tattttctattgcacttgttttcaat

SEQ ID NO: 236876 - DNA, 26 bp, Artificial sequence
  SiRNA target sequence
attttctattgcacttgttttcaatg

SEQ ID NO: 236877 - DNA, 26 bp, Artificial sequence
  SiRNA target sequence
ttttctattgcacttgttttcaatga

SEQ ID NO: 236878 - DNA, 26 bp, Artificial sequence
  SiRNA target sequence
tttctattgcacttgttttcaatgaa

SEQ ID NO: 236879 - DNA, 26 bp, Artificial sequence
  SiRNA target sequence
ttctattgcacttgttttcaatgaat

SEQ ID NO: 236880 - DNA, 26 bp, Artificial sequence
  SiRNA target sequence
tctattgcacttgttttcaatgaatg

SEQ ID NO: 236881 - DNA, 26 bp, Artificial sequence
  SiRNA target sequence
ctattgcacttgttttcaatgaatgg

SEQ ID NO: 236882 - DNA, 26 bp, Artificial sequence
  SiRNA target sequence
tattgcacttgttttcaatgaatgga

SEQ ID NO: 236883 - DNA, 26 bp, Artificial sequence
  SiRNA target sequence
attgcacttgttttcaatgaatggac

SEQ ID NO: 236884 - DNA, 26 bp, Artificial sequence
  SiRNA target sequence
ttgcacttgttttcaatgaatggaca

SEQ ID NO: 236885 - DNA, 26 bp, Artificial sequence
  SiRNA target sequence
tgcacttgttttcaatgaatggacaa

SEQ ID NO: 236886 - DNA, 26 bp, Artificial sequence
  SiRNA target sequence
gcacttgttttcaatgaatggacaag

SEQ ID NO: 236887 - DNA, 26 bp, Artificial sequence
  SiRNA target sequence
cacttgttttcaatgaatggacaagt

SEQ ID NO: 236888 - DNA, 26 bp, Artificial sequence
  SiRNA target sequence
acttgttttcaatgaatggacaagtt

SEQ ID NO: 236889 - DNA, 26 bp, Artificial sequence
  SiRNA target sequence
cttgttttcaatgaatggacaagttc

SEQ ID NO: 236890 - DNA, 26 bp, Artificial sequence
  SiRNA target sequence
ttgttttcaatgaatggacaagttct

SEQ ID NO: 236891 - DNA, 26 bp, Artificial sequence
  SiRNA target sequence
tgttttcaatgaatggacaagttctg

SEQ ID NO: 236892 - DNA, 26 bp, Artificial sequence
  SiRNA target sequence
gttttcaatgaatggacaagttctgc

SEQ ID NO: 236893 - DNA, 26 bp, Artificial sequence
  SiRNA target sequence
ttttcaatgaatggacaagttctgct

SEQ ID NO: 236894 - DNA, 26 bp, Artificial sequence
  SiRNA target sequence
tttcaatgaatggacaagttctgcta

SEQ ID NO: 236895 - DNA, 26 bp, Artificial sequence
  SiRNA target sequence
ttcaatgaatggacaagttctgctat

SEQ ID NO: 236896 - DNA, 26 bp, Artificial sequence
  SiRNA target sequence
tcaatgaatggacaagttctgctatc

SEQ ID NO: 236897 - DNA, 26 bp, Artificial sequence
  SiRNA target sequence
caatgaatggacaagttctgctatct

SEQ ID NO: 236898 - DNA, 26 bp, Artificial sequence
  SiRNA target sequence
aatgaatggacaagttctgctatcta

SEQ ID NO: 236899 - DNA, 26 bp, Artificial sequence
  SiRNA target sequence
atgaatggacaagttctgctatctat

SEQ ID NO: 236900 - DNA, 26 bp, Artificial sequence
  SiRNA target sequence
tgaatggacaagttctgctatctatg

SEQ ID NO: 236901 - DNA, 26 bp, Artificial sequence
  SiRNA target sequence
gaatggacaagttctgctatctatgt

SEQ ID NO: 236902 - DNA, 26 bp, Artificial sequence
  SiRNA target sequence
aatggacaagttctgctatctatgtt

SEQ ID NO: 236903 - DNA, 26 bp, Artificial sequence
  SiRNA target sequence
atggacaagttctgctatctatgttt

SEQ ID NO: 236904 - DNA, 26 bp, Artificial sequence
  SiRNA target sequence
tggacaagttctgctatctatgtttt

SEQ ID NO: 236905 - DNA, 26 bp, Artificial sequence
  SiRNA target sequence
ggacaagttctgctatctatgtttta

SEQ ID NO: 236906 - DNA, 26 bp, Artificial sequence
  SiRNA target sequence
gacaagttctgctatctatgttttat

SEQ ID NO: 236907 - DNA, 26 bp, Artificial sequence
  SiRNA target sequence
acaagttctgctatctatgttttatc

SEQ ID NO: 236908 - DNA, 26 bp, Artificial sequence
  SiRNA target sequence
caagttctgctatctatgttttatct

SEQ ID NO: 236909 - DNA, 26 bp, Artificial sequence
  SiRNA target sequence
aagttctgctatctatgttttatctg

SEQ ID NO: 236910 - DNA, 26 bp, Artificial sequence
  SiRNA target sequence
agttctgctatctatgttttatctga

SEQ ID NO: 236911 - DNA, 26 bp, Artificial sequence
  SiRNA target sequence
gttctgctatctatgttttatctgaa

SEQ ID NO: 236912 - DNA, 26 bp, Artificial sequence
  SiRNA target sequence
ttctgctatctatgttttatctgaaa

SEQ ID NO: 236913 - DNA, 26 bp, Artificial sequence
  SiRNA target sequence
tctgctatctatgttttatctgaaat

SEQ ID NO: 236914 - DNA, 26 bp, Artificial sequence
  SiRNA target sequence
ctgctatctatgttttatctgaaatg

SEQ ID NO: 236915 - DNA, 26 bp, Artificial sequence
  SiRNA target sequence
tgctatctatgttttatctgaaatgt

SEQ ID NO: 236916 - DNA, 26 bp, Artificial sequence
  SiRNA target sequence
gctatctatgttttatctgaaatgtt

SEQ ID NO: 236917 - DNA, 26 bp, Artificial sequence
  SiRNA target sequence
ctatctatgttttatctgaaatgttt

SEQ ID NO: 236918 - DNA, 26 bp, Artificial sequence
  SiRNA target sequence
tatctatgttttatctgaaatgtttg

SEQ ID NO: 236919 - DNA, 26 bp, Artificial sequence
  SiRNA target sequence
atctatgttttatctgaaatgtttgg

SEQ ID NO: 236920 - DNA, 26 bp, Artificial sequence
  SiRNA target sequence
tctatgttttatctgaaatgtttggt

SEQ ID NO: 236921 - DNA, 26 bp, Artificial sequence
  SiRNA target sequence
ctatgttttatctgaaatgtttggta

SEQ ID NO: 236922 - DNA, 26 bp, Artificial sequence
  SiRNA target sequence
tatgttttatctgaaatgtttggtag

SEQ ID NO: 236923 - DNA, 26 bp, Artificial sequence
  SiRNA target sequence
atgttttatctgaaatgtttggtagt

SEQ ID NO: 236924 - DNA, 26 bp, Artificial sequence
  SiRNA target sequence
tgttttatctgaaatgtttggtagtt

SEQ ID NO: 236925 - DNA, 26 bp, Artificial sequence
  SiRNA target sequence
gttttatctgaaatgtttggtagttt

SEQ ID NO: 236926 - DNA, 26 bp, Artificial sequence
  SiRNA target sequence
ttttatctgaaatgtttggtagtttg

SEQ ID NO: 236927 - DNA, 26 bp, Artificial sequence
  SiRNA target sequence
tttatctgaaatgtttggtagtttga

SEQ ID NO: 236928 - DNA, 26 bp, Artificial sequence
  SiRNA target sequence
ttatctgaaatgtttggtagtttgat

SEQ ID NO: 236929 - DNA, 26 bp, Artificial sequence
  SiRNA target sequence
tatctgaaatgtttggtagtttgatt

SEQ ID NO: 236930 - DNA, 26 bp, Artificial sequence
  SiRNA target sequence
atctgaaatgtttggtagtttgattc

SEQ ID NO: 236931 - DNA, 26 bp, Artificial sequence
  SiRNA target sequence
tctgaaatgtttggtagtttgattct

SEQ ID NO: 236932 - DNA, 26 bp, Artificial sequence
  SiRNA target sequence
ctgaaatgtttggtagtttgattctt

SEQ ID NO: 236933 - DNA, 26 bp, Artificial sequence
  SiRNA target sequence
tgaaatgtttggtagtttgattcttt

SEQ ID NO: 236934 - DNA, 26 bp, Artificial sequence
  SiRNA target sequence
gaaatgtttggtagtttgattctttc

SEQ ID NO: 236935 - DNA, 26 bp, Artificial sequence
  SiRNA target sequence
aaatgtttggtagtttgattctttca

SEQ ID NO: 236936 - DNA, 26 bp, Artificial sequence
  SiRNA target sequence
aatgtttggtagtttgattctttcat

SEQ ID NO: 236937 - DNA, 26 bp, Artificial sequence
  SiRNA target sequence
atgtttggtagtttgattctttcata

SEQ ID NO: 236938 - DNA, 26 bp, Artificial sequence
  SiRNA target sequence
tgtttggtagtttgattctttcatat

SEQ ID NO: 236939 - DNA, 26 bp, Artificial sequence
  SiRNA target sequence
gtttggtagtttgattctttcatatt

SEQ ID NO: 236940 - DNA, 26 bp, Artificial sequence
  SiRNA target sequence
tttggtagtttgattctttcatattt

SEQ ID NO: 236941 - DNA, 26 bp, Artificial sequence
  SiRNA target sequence
ttggtagtttgattctttcatattta

SEQ ID NO: 236942 - DNA, 26 bp, Artificial sequence
  SiRNA target sequence
tggtagtttgattctttcatatttat

SEQ ID NO: 236943 - DNA, 26 bp, Artificial sequence
  SiRNA target sequence
ggtagtttgattctttcatatttatt

SEQ ID NO: 236944 - DNA, 26 bp, Artificial sequence
  SiRNA target sequence
gtagtttgattctttcatatttattt

SEQ ID NO: 236945 - DNA, 26 bp, Artificial sequence
  SiRNA target sequence
tagtttgattctttcatatttattta

SEQ ID NO: 236946 - DNA, 26 bp, Artificial sequence
  SiRNA target sequence
agtttgattctttcatatttatttat

SEQ ID NO: 236947 - DNA, 26 bp, Artificial sequence
  SiRNA target sequence
gtttgattctttcatatttatttatg

SEQ ID NO: 236948 - DNA, 26 bp, Artificial sequence
  SiRNA target sequence
tttgattctttcatatttatttatga

SEQ ID NO: 236949 - DNA, 26 bp, Artificial sequence
  SiRNA target sequence
ttgattctttcatatttatttatgac

SEQ ID NO: 236950 - DNA, 26 bp, Artificial sequence
  SiRNA target sequence
tgattctttcatatttatttatgacg

SEQ ID NO: 236951 - DNA, 26 bp, Artificial sequence
  SiRNA target sequence
gattctttcatatttatttatgacgt

SEQ ID NO: 236952 - DNA, 26 bp, Artificial sequence
  SiRNA target sequence
attctttcatatttatttatgacgtt

SEQ ID NO: 236953 - DNA, 26 bp, Artificial sequence
  SiRNA target sequence
ttctttcatatttatttatgacgttt

SEQ ID NO: 236954 - DNA, 26 bp, Artificial sequence
  SiRNA target sequence
tctttcatatttatttatgacgtttg

SEQ ID NO: 236955 - DNA, 26 bp, Artificial sequence
  SiRNA target sequence
ctttcatatttatttatgacgtttgc

SEQ ID NO: 236956 - DNA, 26 bp, Artificial sequence
  SiRNA target sequence
tttcatatttatttatgacgtttgct

SEQ ID NO: 236957 - DNA, 26 bp, Artificial sequence
  SiRNA target sequence
ttcatatttatttatgacgtttgcta

SEQ ID NO: 236958 - DNA, 26 bp, Artificial sequence
  SiRNA target sequence
tcatatttatttatgacgtttgctaa

SEQ ID NO: 236959 - DNA, 26 bp, Artificial sequence
  SiRNA target sequence
catatttatttatgacgtttgctaat

SEQ ID NO: 236960 - DNA, 26 bp, Artificial sequence
  SiRNA target sequence
atatttatttatgacgtttgctaatg

SEQ ID NO: 236961 - DNA, 26 bp, Artificial sequence
  SiRNA target sequence
tatttatttatgacgtttgctaatgg

SEQ ID NO: 236962 - DNA, 26 bp, Artificial sequence
  SiRNA target sequence
atttatttatgacgtttgctaatggt

SEQ ID NO: 236963 - DNA, 26 bp, Artificial sequence
  SiRNA target sequence
tttatttatgacgtttgctaatggtc

SEQ ID NO: 236964 - DNA, 26 bp, Artificial sequence
  SiRNA target sequence
ttatttatgacgtttgctaatggtct

SEQ ID NO: 236965 - DNA, 26 bp, Artificial sequence
  SiRNA target sequence
tatttatgacgtttgctaatggtctt

SEQ ID NO: 236966 - DNA, 26 bp, Artificial sequence
  SiRNA target sequence
atttatgacgtttgctaatggtcttt

SEQ ID NO: 236967 - DNA, 26 bp, Artificial sequence
  SiRNA target sequence
tttatgacgtttgctaatggtctttc

SEQ ID NO: 236968 - DNA, 26 bp, Artificial sequence
  SiRNA target sequence
ttatgacgtttgctaatggtctttcg

SEQ ID NO: 236969 - DNA, 26 bp, Artificial sequence
  SiRNA target sequence
tatgacgtttgctaatggtctttcga

SEQ ID NO: 236970 - DNA, 26 bp, Artificial sequence
  SiRNA target sequence
atgacgtttgctaatggtctttcgac

SEQ ID NO: 236971 - DNA, 26 bp, Artificial sequence
  SiRNA target sequence
tgacgtttgctaatggtctttcgact

SEQ ID NO: 236972 - DNA, 26 bp, Artificial sequence
  SiRNA target sequence
gacgtttgctaatggtctttcgactc

SEQ ID NO: 236973 - DNA, 26 bp, Artificial sequence
  SiRNA target sequence
acgtttgctaatggtctttcgactcc

SEQ ID NO: 236974 - DNA, 26 bp, Artificial sequence
  SiRNA target sequence
cgtttgctaatggtctttcgactcct

SEQ ID NO: 236975 - DNA, 26 bp, Artificial sequence
  SiRNA target sequence
gtttgctaatggtctttcgactcctg

SEQ ID NO: 236976 - DNA, 26 bp, Artificial sequence
  SiRNA target sequence
tttgctaatggtctttcgactcctgg

SEQ ID NO: 236977 - DNA, 26 bp, Artificial sequence
  SiRNA target sequence
ttgctaatggtctttcgactcctgga

SEQ ID NO: 236978 - DNA, 26 bp, Artificial sequence
  SiRNA target sequence
tgctaatggtctttcgactcctggac

SEQ ID NO: 236979 - DNA, 26 bp, Artificial sequence
  SiRNA target sequence
gctaatggtctttcgactcctggaca

SEQ ID NO: 236980 - DNA, 26 bp, Artificial sequence
  SiRNA target sequence
ctaatggtctttcgactcctggacag

SEQ ID NO: 236981 - DNA, 26 bp, Artificial sequence
  SiRNA target sequence
taatggtctttcgactcctggacagt

SEQ ID NO: 236982 - DNA, 26 bp, Artificial sequence
  SiRNA target sequence
aatggtctttcgactcctggacagtc

SEQ ID NO: 236983 - DNA, 26 bp, Artificial sequence
  SiRNA target sequence
atggtctttcgactcctggacagtcc

SEQ ID NO: 236984 - DNA, 26 bp, Artificial sequence
  SiRNA target sequence
tggtctttcgactcctggacagtccg

SEQ ID NO: 236985 - DNA, 26 bp, Artificial sequence
  SiRNA target sequence
ggtctttcgactcctggacagtccgc

SEQ ID NO: 236986 - DNA, 26 bp, Artificial sequence
  SiRNA target sequence
gtctttcgactcctggacagtccgct

SEQ ID NO: 236987 - DNA, 26 bp, Artificial sequence
  SiRNA target sequence
tctttcgactcctggacagtccgcta

SEQ ID NO: 236988 - DNA, 26 bp, Artificial sequence
  SiRNA target sequence
ctttcgactcctggacagtccgctag

SEQ ID NO: 236989 - DNA, 26 bp, Artificial sequence
  SiRNA target sequence
tttcgactcctggacagtccgctaga

SEQ ID NO: 236990 - DNA, 26 bp, Artificial sequence
  SiRNA target sequence
ttcgactcctggacagtccgctagat

SEQ ID NO: 236991 - DNA, 26 bp, Artificial sequence
  SiRNA target sequence
tcgactcctggacagtccgctagatt

SEQ ID NO: 236992 - DNA, 26 bp, Artificial sequence
  SiRNA target sequence
cgactcctggacagtccgctagattt

SEQ ID NO: 236993 - DNA, 26 bp, Artificial sequence
  SiRNA target sequence
gactcctggacagtccgctagatttg

SEQ ID NO: 236994 - DNA, 26 bp, Artificial sequence
  SiRNA target sequence
actcctggacagtccgctagatttgt

SEQ ID NO: 236995 - DNA, 26 bp, Artificial sequence
  SiRNA target sequence
ctcctggacagtccgctagatttgtc

SEQ ID NO: 236996 - DNA, 26 bp, Artificial sequence
  SiRNA target sequence
tcctggacagtccgctagatttgtcc

SEQ ID NO: 236997 - DNA, 26 bp, Artificial sequence
  SiRNA target sequence
cctggacagtccgctagatttgtccc

SEQ ID NO: 236998 - DNA, 26 bp, Artificial sequence
  SiRNA target sequence
ctggacagtccgctagatttgtccct

SEQ ID NO: 236999 - DNA, 26 bp, Artificial sequence
  SiRNA target sequence
tggacagtccgctagatttgtccctt

SEQ ID NO: 237000 - DNA, 26 bp, Artificial sequence
  SiRNA target sequence
ggacagtccgctagatttgtcccttt

SEQ ID NO: 237001 - DNA, 26 bp, Artificial sequence
  SiRNA target sequence
gacagtccgctagatttgtcccttta

SEQ ID NO: 237002 - DNA, 26 bp, Artificial sequence
  SiRNA target sequence
acagtccgctagatttgtccctttat

SEQ ID NO: 237003 - DNA, 26 bp, Artificial sequence
  SiRNA target sequence
cagtccgctagatttgtccctttatt

SEQ ID NO: 237004 - DNA, 26 bp, Artificial sequence
  SiRNA target sequence
agtccgctagatttgtccctttattt

SEQ ID NO: 237005 - DNA, 26 bp, Artificial sequence
  SiRNA target sequence
gtccgctagatttgtccctttatttt

SEQ ID NO: 237006 - DNA, 26 bp, Artificial sequence
  SiRNA target sequence
tccgctagatttgtccctttatttta

SEQ ID NO: 237007 - DNA, 26 bp, Artificial sequence
  SiRNA target sequence
ccgctagatttgtccctttattttat

SEQ ID NO: 237008 - DNA, 26 bp, Artificial sequence
  SiRNA target sequence
cgctagatttgtccctttattttatg

SEQ ID NO: 237009 - DNA, 26 bp, Artificial sequence
  SiRNA target sequence
gctagatttgtccctttattttatgt

SEQ ID NO: 237010 - DNA, 26 bp, Artificial sequence
  SiRNA target sequence
ctagatttgtccctttattttatgtt

SEQ ID NO: 237011 - DNA, 26 bp, Artificial sequence
  SiRNA target sequence
tagatttgtccctttattttatgttg

SEQ ID NO: 237012 - DNA, 26 bp, Artificial sequence
  SiRNA target sequence
agatttgtccctttattttatgttgg

SEQ ID NO: 237013 - DNA, 26 bp, Artificial sequence
  SiRNA target sequence
gatttgtccctttattttatgttgga

SEQ ID NO: 237014 - DNA, 26 bp, Artificial sequence
  SiRNA target sequence
atttgtccctttattttatgttggat

SEQ ID NO: 237015 - DNA, 26 bp, Artificial sequence
  SiRNA target sequence
tttgtccctttattttatgttggatc

SEQ ID NO: 237016 - DNA, 26 bp, Artificial sequence
  SiRNA target sequence
ttgtccctttattttatgttggatct

SEQ ID NO: 237017 - DNA, 26 bp, Artificial sequence
  SiRNA target sequence
tgtccctttattttatgttggatcta

SEQ ID NO: 237018 - DNA, 26 bp, Artificial sequence
  SiRNA target sequence
gtccctttattttatgttggatctaa

SEQ ID NO: 237019 - DNA, 26 bp, Artificial sequence
  SiRNA target sequence
tccctttattttatgttggatctaat

SEQ ID NO: 237020 - DNA, 26 bp, Artificial sequence
  SiRNA target sequence
ccctttattttatgttggatctaatt

SEQ ID NO: 237021 - DNA, 26 bp, Artificial sequence
  SiRNA target sequence
cctttattttatgttggatctaattt

SEQ ID NO: 237022 - DNA, 26 bp, Artificial sequence
  SiRNA target sequence
ctttattttatgttggatctaatttg

SEQ ID NO: 237023 - DNA, 26 bp, Artificial sequence
  SiRNA target sequence
tttattttatgttggatctaatttgg

SEQ ID NO: 237024 - DNA, 26 bp, Artificial sequence
  SiRNA target sequence
ttattttatgttggatctaatttggc

SEQ ID NO: 237025 - DNA, 26 bp, Artificial sequence
  SiRNA target sequence
tattttatgttggatctaatttggct

SEQ ID NO: 237026 - DNA, 26 bp, Artificial sequence
  SiRNA target sequence
attttatgttggatctaatttggctt

SEQ ID NO: 237027 - DNA, 26 bp, Artificial sequence
  SiRNA target sequence
ttttatgttggatctaatttggcttt

SEQ ID NO: 237028 - DNA, 26 bp, Artificial sequence
  SiRNA target sequence
tttatgttggatctaatttggcttta

SEQ ID NO: 237029 - DNA, 26 bp, Artificial sequence
  SiRNA target sequence
ttatgttggatctaatttggctttac

SEQ ID NO: 237030 - DNA, 26 bp, Artificial sequence
  SiRNA target sequence
tatgttggatctaatttggctttact

SEQ ID NO: 237031 - DNA, 26 bp, Artificial sequence
  SiRNA target sequence
atgttggatctaatttggctttactt

SEQ ID NO: 237032 - DNA, 26 bp, Artificial sequence
  SiRNA target sequence
tgttggatctaatttggctttacttc

SEQ ID NO: 237033 - DNA, 26 bp, Artificial sequence
  SiRNA target sequence
gttggatctaatttggctttacttct

SEQ ID NO: 237034 - DNA, 26 bp, Artificial sequence
  SiRNA target sequence
ttggatctaatttggctttacttctt

SEQ ID NO: 237035 - DNA, 26 bp, Artificial sequence
  SiRNA target sequence
tggatctaatttggctttacttcttt

SEQ ID NO: 237036 - DNA, 26 bp, Artificial sequence
  SiRNA target sequence
ggatctaatttggctttacttctttc

SEQ ID NO: 237037 - DNA, 26 bp, Artificial sequence
  SiRNA target sequence
gatctaatttggctttacttctttca

SEQ ID NO: 237038 - DNA, 26 bp, Artificial sequence
  SiRNA target sequence
atctaatttggctttacttctttcag

SEQ ID NO: 237039 - DNA, 26 bp, Artificial sequence
  SiRNA target sequence
tctaatttggctttacttctttcagg

SEQ ID NO: 237040 - DNA, 26 bp, Artificial sequence
  SiRNA target sequence
ctaatttggctttacttctttcagga

SEQ ID NO: 237041 - DNA, 26 bp, Artificial sequence
  SiRNA target sequence
taatttggctttacttctttcaggaa

SEQ ID NO: 237042 - DNA, 26 bp, Artificial sequence
  SiRNA target sequence
aatttggctttacttctttcaggaat

SEQ ID NO: 237043 - DNA, 26 bp, Artificial sequence
  SiRNA target sequence
atttggctttacttctttcaggaatg

SEQ ID NO: 237044 - DNA, 26 bp, Artificial sequence
  SiRNA target sequence
tttggctttacttctttcaggaatga

SEQ ID NO: 237045 - DNA, 26 bp, Artificial sequence
  SiRNA target sequence
ttggctttacttctttcaggaatgat

SEQ ID NO: 237046 - DNA, 26 bp, Artificial sequence
  SiRNA target sequence
tggctttacttctttcaggaatgata

SEQ ID NO: 237047 - DNA, 26 bp, Artificial sequence
  SiRNA target sequence
ggctttacttctttcaggaatgataa

SEQ ID NO: 237048 - DNA, 26 bp, Artificial sequence
  SiRNA target sequence
gctttacttctttcaggaatgataaa

SEQ ID NO: 237049 - DNA, 26 bp, Artificial sequence
  SiRNA target sequence
ctttacttctttcaggaatgataaat

SEQ ID NO: 237050 - DNA, 26 bp, Artificial sequence
  SiRNA target sequence
tttacttctttcaggaatgataaatt

SEQ ID NO: 237051 - DNA, 26 bp, Artificial sequence
  SiRNA target sequence
ttacttctttcaggaatgataaatta

SEQ ID NO: 237052 - DNA, 26 bp, Artificial sequence
  SiRNA target sequence
tacttctttcaggaatgataaattac

SEQ ID NO: 237053 - DNA, 26 bp, Artificial sequence
  SiRNA target sequence
acttctttcaggaatgataaattact

SEQ ID NO: 237054 - DNA, 26 bp, Artificial sequence
  SiRNA target sequence
cttctttcaggaatgataaattactt

SEQ ID NO: 237055 - DNA, 26 bp, Artificial sequence
  SiRNA target sequence
ttctttcaggaatgataaattacttt

SEQ ID NO: 237056 - DNA, 26 bp, Artificial sequence
  SiRNA target sequence
tctttcaggaatgataaattactttt

SEQ ID NO: 237057 - DNA, 26 bp, Artificial sequence
  SiRNA target sequence
ctttcaggaatgataaattactttta

SEQ ID NO: 237058 - DNA, 26 bp, Artificial sequence
  SiRNA target sequence
tttcaggaatgataaattacttttat

SEQ ID NO: 237059 - DNA, 26 bp, Artificial sequence
  SiRNA target sequence
ttcaggaatgataaattacttttata

SEQ ID NO: 237060 - DNA, 26 bp, Artificial sequence
  SiRNA target sequence
tcaggaatgataaattacttttatag

SEQ ID NO: 237061 - DNA, 26 bp, Artificial sequence
  SiRNA target sequence
caggaatgataaattacttttatagt

SEQ ID NO: 237062 - DNA, 26 bp, Artificial sequence
  SiRNA target sequence
aggaatgataaattacttttatagtg

SEQ ID NO: 237063 - DNA, 26 bp, Artificial sequence
  SiRNA target sequence
ggaatgataaattacttttatagtgt

SEQ ID NO: 237064 - DNA, 26 bp, Artificial sequence
  SiRNA target sequence
gaatgataaattacttttatagtgta

SEQ ID NO: 237065 - DNA, 26 bp, Artificial sequence
  SiRNA target sequence
aatgataaattacttttatagtgtaa

SEQ ID NO: 237066 - DNA, 26 bp, Artificial sequence
  SiRNA target sequence
atgataaattacttttatagtgtaag

SEQ ID NO: 237067 - DNA, 26 bp, Artificial sequence
  SiRNA target sequence
tgataaattacttttatagtgtaagt

SEQ ID NO: 237068 - DNA, 26 bp, Artificial sequence
  SiRNA target sequence
gataaattacttttatagtgtaagta

SEQ ID NO: 237069 - DNA, 26 bp, Artificial sequence
  SiRNA target sequence
ataaattacttttatagtgtaagtaa

SEQ ID NO: 237070 - DNA, 26 bp, Artificial sequence
  SiRNA target sequence
taaattacttttatagtgtaagtaaa

SEQ ID NO: 237071 - DNA, 26 bp, Artificial sequence
  SiRNA target sequence
aaattacttttatagtgtaagtaaat

SEQ ID NO: 237072 - DNA, 26 bp, Artificial sequence
  SiRNA target sequence
aattacttttatagtgtaagtaaatc

SEQ ID NO: 237073 - DNA, 26 bp, Artificial sequence
  SiRNA target sequence
attacttttatagtgtaagtaaatct

SEQ ID NO: 237074 - DNA, 26 bp, Artificial sequence
  SiRNA target sequence
ttacttttatagtgtaagtaaatcta

SEQ ID NO: 237075 - DNA, 26 bp, Artificial sequence
  SiRNA target sequence
tacttttatagtgtaagtaaatctaa

SEQ ID NO: 237076 - DNA, 26 bp, Artificial sequence
  SiRNA target sequence
acttttatagtgtaagtaaatctaaa

SEQ ID NO: 237077 - DNA, 26 bp, Artificial sequence
  SiRNA target sequence
cttttatagtgtaagtaaatctaaaa

SEQ ID NO: 237078 - DNA, 26 bp, Artificial sequence
  SiRNA target sequence
ttttatagtgtaagtaaatctaaaat

SEQ ID NO: 237079 - DNA, 26 bp, Artificial sequence
  SiRNA target sequence
tttatagtgtaagtaaatctaaaatg

SEQ ID NO: 237080 - DNA, 26 bp, Artificial sequence
  SiRNA target sequence
ttatagtgtaagtaaatctaaaatgt

SEQ ID NO: 237081 - DNA, 26 bp, Artificial sequence
  SiRNA target sequence
tatagtgtaagtaaatctaaaatgtc

SEQ ID NO: 237082 - DNA, 26 bp, Artificial sequence
  SiRNA target sequence
atagtgtaagtaaatctaaaatgtcg

SEQ ID NO: 237083 - DNA, 26 bp, Artificial sequence
  SiRNA target sequence
tagtgtaagtaaatctaaaatgtcgt

SEQ ID NO: 237084 - DNA, 26 bp, Artificial sequence
  SiRNA target sequence
agtgtaagtaaatctaaaatgtcgta

SEQ ID NO: 237085 - DNA, 26 bp, Artificial sequence
  SiRNA target sequence
gtgtaagtaaatctaaaatgtcgtat

SEQ ID NO: 237086 - DNA, 26 bp, Artificial sequence
  SiRNA target sequence
tgtaagtaaatctaaaatgtcgtatg

SEQ ID NO: 237087 - DNA, 26 bp, Artificial sequence
  SiRNA target sequence
gtaagtaaatctaaaatgtcgtatgt

SEQ ID NO: 237088 - DNA, 26 bp, Artificial sequence
  SiRNA target sequence
taagtaaatctaaaatgtcgtatgtt

SEQ ID NO: 237089 - DNA, 26 bp, Artificial sequence
  SiRNA target sequence
aagtaaatctaaaatgtcgtatgttg

SEQ ID NO: 237090 - DNA, 26 bp, Artificial sequence
  SiRNA target sequence
agtaaatctaaaatgtcgtatgttgc

SEQ ID NO: 237091 - DNA, 26 bp, Artificial sequence
  SiRNA target sequence
gtaaatctaaaatgtcgtatgttgcg

SEQ ID NO: 237092 - DNA, 26 bp, Artificial sequence
  SiRNA target sequence
taaatctaaaatgtcgtatgttgcgg

SEQ ID NO: 237093 - DNA, 26 bp, Artificial sequence
  SiRNA target sequence
aaatctaaaatgtcgtatgttgcggc

SEQ ID NO: 237094 - DNA, 26 bp, Artificial sequence
  SiRNA target sequence
aatctaaaatgtcgtatgttgcggcc

SEQ ID NO: 237095 - DNA, 26 bp, Artificial sequence
  SiRNA target sequence
atctaaaatgtcgtatgttgcggccg

SEQ ID NO: 237096 - DNA, 26 bp, Artificial sequence
  SiRNA target sequence
tctaaaatgtcgtatgttgcggccga

SEQ ID NO: 237097 - DNA, 26 bp, Artificial sequence
  SiRNA target sequence
ctaaaatgtcgtatgttgcggccgaa

SEQ ID NO: 237098 - DNA, 26 bp, Artificial sequence
  SiRNA target sequence
taaaatgtcgtatgttgcggccgaaa

SEQ ID NO: 237099 - DNA, 26 bp, Artificial sequence
  SiRNA target sequence
aaaatgtcgtatgttgcggccgaaag

SEQ ID NO: 237100 - DNA, 26 bp, Artificial sequence
  SiRNA target sequence
aaatgtcgtatgttgcggccgaaaga

SEQ ID NO: 237101 - DNA, 26 bp, Artificial sequence
  SiRNA target sequence
aatgtcgtatgttgcggccgaaagat

SEQ ID NO: 237102 - DNA, 26 bp, Artificial sequence
  SiRNA target sequence
atgtcgtatgttgcggccgaaagatt

SEQ ID NO: 237103 - DNA, 26 bp, Artificial sequence
  SiRNA target sequence
tgtcgtatgttgcggccgaaagattt

SEQ ID NO: 237104 - DNA, 26 bp, Artificial sequence
  SiRNA target sequence
gtcgtatgttgcggccgaaagatttt

SEQ ID NO: 237105 - DNA, 26 bp, Artificial sequence
  SiRNA target sequence
tcgtatgttgcggccgaaagattttt

SEQ ID NO: 237106 - DNA, 26 bp, Artificial sequence
  SiRNA target sequence
cgtatgttgcggccgaaagatttttt

SEQ ID NO: 237107 - DNA, 26 bp, Artificial sequence
  SiRNA target sequence
gtatgttgcggccgaaagatttttta

SEQ ID NO: 237108 - DNA, 26 bp, Artificial sequence
  SiRNA target sequence
tatgttgcggccgaaagattttttaa

SEQ ID NO: 237109 - DNA, 26 bp, Artificial sequence
  SiRNA target sequence
atgttgcggccgaaagattttttaat

SEQ ID NO: 237110 - DNA, 26 bp, Artificial sequence
  SiRNA target sequence
tgttgcggccgaaagattttttaatg

SEQ ID NO: 237111 - DNA, 26 bp, Artificial sequence
  SiRNA target sequence
gttgcggccgaaagattttttaatgg

SEQ ID NO: 237112 - DNA, 26 bp, Artificial sequence
  SiRNA target sequence
ttgcggccgaaagattttttaatgga

SEQ ID NO: 237113 - DNA, 26 bp, Artificial sequence
  SiRNA target sequence
tgcggccgaaagattttttaatggat

SEQ ID NO: 237114 - DNA, 26 bp, Artificial sequence
  SiRNA target sequence
gcggccgaaagattttttaatggatt

SEQ ID NO: 237115 - DNA, 26 bp, Artificial sequence
  SiRNA target sequence
cggccgaaagattttttaatggattt

SEQ ID NO: 237116 - DNA, 26 bp, Artificial sequence
  SiRNA target sequence
ggccgaaagattttttaatggatttt

SEQ ID NO: 237117 - DNA, 26 bp, Artificial sequence
  SiRNA target sequence
gccgaaagattttttaatggattttt

SEQ ID NO: 237118 - DNA, 26 bp, Artificial sequence
  SiRNA target sequence
ccgaaagattttttaatggatttttt

SEQ ID NO: 237119 - DNA, 26 bp, Artificial sequence
  SiRNA target sequence
cgaaagattttttaatggattttttt

SEQ ID NO: 237120 - DNA, 26 bp, Artificial sequence
  SiRNA target sequence
gaaagattttttaatggatttttttg

SEQ ID NO: 237121 - DNA, 26 bp, Artificial sequence
  SiRNA target sequence
aaagattttttaatggatttttttgt

SEQ ID NO: 237122 - DNA, 26 bp, Artificial sequence
  SiRNA target sequence
aagattttttaatggatttttttgtc

SEQ ID NO: 237123 - DNA, 26 bp, Artificial sequence
  SiRNA target sequence
agattttttaatggatttttttgtct

SEQ ID NO: 237124 - DNA, 26 bp, Artificial sequence
  SiRNA target sequence
gattttttaatggatttttttgtctg

SEQ ID NO: 237125 - DNA, 26 bp, Artificial sequence
  SiRNA target sequence
attttttaatggatttttttgtctga

SEQ ID NO: 237126 - DNA, 26 bp, Artificial sequence
  SiRNA target sequence
ttttttaatggatttttttgtctgag

SEQ ID NO: 237127 - DNA, 26 bp, Artificial sequence
  SiRNA target sequence
tttttaatggatttttttgtctgagt

SEQ ID NO: 237128 - DNA, 26 bp, Artificial sequence
  SiRNA target sequence
ttttaatggatttttttgtctgagtg

SEQ ID NO: 237129 - DNA, 26 bp, Artificial sequence
  SiRNA target sequence
tttaatggatttttttgtctgagtgg

SEQ ID NO: 237130 - DNA, 26 bp, Artificial sequence
  SiRNA target sequence
ttaatggatttttttgtctgagtgga

SEQ ID NO: 237131 - DNA, 26 bp, Artificial sequence
  SiRNA target sequence
taatggatttttttgtctgagtggaa

SEQ ID NO: 237132 - DNA, 26 bp, Artificial sequence
  SiRNA target sequence
aatggatttttttgtctgagtggaat

SEQ ID NO: 237133 - DNA, 26 bp, Artificial sequence
  SiRNA target sequence
atggatttttttgtctgagtggaatt

SEQ ID NO: 237134 - DNA, 26 bp, Artificial sequence
  SiRNA target sequence
tggatttttttgtctgagtggaattc

SEQ ID NO: 237135 - DNA, 26 bp, Artificial sequence
  SiRNA target sequence
ggatttttttgtctgagtggaattct

SEQ ID NO: 237136 - DNA, 26 bp, Artificial sequence
  SiRNA target sequence
gatttttttgtctgagtggaattctc

SEQ ID NO: 237137 - DNA, 26 bp, Artificial sequence
  SiRNA target sequence
atttttttgtctgagtggaattctct

SEQ ID NO: 237138 - DNA, 26 bp, Artificial sequence
  SiRNA target sequence
tttttttgtctgagtggaattctctg

SEQ ID NO: 237139 - DNA, 26 bp, Artificial sequence
  SiRNA target sequence
ttttttgtctgagtggaattctctgt

SEQ ID NO: 237140 - DNA, 26 bp, Artificial sequence
  SiRNA target sequence
tttttgtctgagtggaattctctgtg

SEQ ID NO: 237141 - DNA, 26 bp, Artificial sequence
  SiRNA target sequence
ttttgtctgagtggaattctctgtgc

SEQ ID NO: 237142 - DNA, 26 bp, Artificial sequence
  SiRNA target sequence
tttgtctgagtggaattctctgtgct

SEQ ID NO: 237143 - DNA, 26 bp, Artificial sequence
  SiRNA target sequence
ttgtctgagtggaattctctgtgctg

SEQ ID NO: 237144 - DNA, 26 bp, Artificial sequence
  SiRNA target sequence
tgtctgagtggaattctctgtgctgt

SEQ ID NO: 237145 - DNA, 26 bp, Artificial sequence
  SiRNA target sequence
gtctgagtggaattctctgtgctgta

SEQ ID NO: 237146 - DNA, 26 bp, Artificial sequence
  SiRNA target sequence
tctgagtggaattctctgtgctgtaa

SEQ ID NO: 237147 - DNA, 26 bp, Artificial sequence
  SiRNA target sequence
ctgagtggaattctctgtgctgtaat

SEQ ID NO: 237148 - DNA, 26 bp, Artificial sequence
  SiRNA target sequence
tgagtggaattctctgtgctgtaatt

SEQ ID NO: 237149 - DNA, 26 bp, Artificial sequence
  SiRNA target sequence
gagtggaattctctgtgctgtaattt

SEQ ID NO: 237150 - DNA, 26 bp, Artificial sequence
  SiRNA target sequence
agtggaattctctgtgctgtaattta

SEQ ID NO: 237151 - DNA, 26 bp, Artificial sequence
  SiRNA target sequence
gtggaattctctgtgctgtaatttat

SEQ ID NO: 237152 - DNA, 26 bp, Artificial sequence
  SiRNA target sequence
tggaattctctgtgctgtaatttatc

SEQ ID NO: 237153 - DNA, 26 bp, Artificial sequence
  SiRNA target sequence
ggaattctctgtgctgtaatttatct

SEQ ID NO: 237154 - DNA, 26 bp, Artificial sequence
  SiRNA target sequence
gaattctctgtgctgtaatttatctt

SEQ ID NO: 237155 - DNA, 26 bp, Artificial sequence
  SiRNA target sequence
aattctctgtgctgtaatttatcttc

SEQ ID NO: 237156 - DNA, 26 bp, Artificial sequence
  SiRNA target sequence
attctctgtgctgtaatttatcttct

SEQ ID NO: 237157 - DNA, 26 bp, Artificial sequence
  SiRNA target sequence
ttctctgtgctgtaatttatcttcta

SEQ ID NO: 237158 - DNA, 26 bp, Artificial sequence
  SiRNA target sequence
tctctgtgctgtaatttatcttctaa

SEQ ID NO: 237159 - DNA, 26 bp, Artificial sequence
  SiRNA target sequence
ctctgtgctgtaatttatcttctaaa

SEQ ID NO: 237160 - DNA, 26 bp, Artificial sequence
  SiRNA target sequence
tctgtgctgtaatttatcttctaaaa

SEQ ID NO: 237161 - DNA, 26 bp, Artificial sequence
  SiRNA target sequence
ctgtgctgtaatttatcttctaaaaa

SEQ ID NO: 237162 - DNA, 26 bp, Artificial sequence
  SiRNA target sequence
tgtgctgtaatttatcttctaaaaaa

SEQ ID NO: 237163 - DNA, 26 bp, Artificial sequence
  SiRNA target sequence
gtgctgtaatttatcttctaaaaaaa

SEQ ID NO: 237164 - DNA, 26 bp, Artificial sequence
  SiRNA target sequence
tgctgtaatttatcttctaaaaaaat

SEQ ID NO: 237165 - DNA, 26 bp, Artificial sequence
  SiRNA target sequence
gctgtaatttatcttctaaaaaaata

SEQ ID NO: 237166 - DNA, 26 bp, Artificial sequence
  SiRNA target sequence
ctgtaatttatcttctaaaaaaatat

SEQ ID NO: 237167 - DNA, 26 bp, Artificial sequence
  SiRNA target sequence
tgtaatttatcttctaaaaaaatatt

SEQ ID NO: 237168 - DNA, 26 bp, Artificial sequence
  SiRNA target sequence
gtaatttatcttctaaaaaaatattt

SEQ ID NO: 237169 - DNA, 26 bp, Artificial sequence
  SiRNA target sequence
taatttatcttctaaaaaaatattta

SEQ ID NO: 237170 - DNA, 26 bp, Artificial sequence
  SiRNA target sequence
aatttatcttctaaaaaaatatttag

SEQ ID NO: 237171 - DNA, 26 bp, Artificial sequence
  SiRNA target sequence
atttatcttctaaaaaaatatttaga

SEQ ID NO: 237172 - DNA, 26 bp, Artificial sequence
  SiRNA target sequence
tttatcttctaaaaaaatatttagaa

SEQ ID NO: 237173 - DNA, 26 bp, Artificial sequence
  SiRNA target sequence
ttatcttctaaaaaaatatttagaaa

SEQ ID NO: 237174 - DNA, 26 bp, Artificial sequence
  SiRNA target sequence
tatcttctaaaaaaatatttagaaaa

SEQ ID NO: 237175 - DNA, 26 bp, Artificial sequence
  SiRNA target sequence
atcttctaaaaaaatatttagaaaat

SEQ ID NO: 237176 - DNA, 26 bp, Artificial sequence
  SiRNA target sequence
tcttctaaaaaaatatttagaaaata

SEQ ID NO: 237177 - DNA, 26 bp, Artificial sequence
  SiRNA target sequence
cttctaaaaaaatatttagaaaataa

SEQ ID NO: 237178 - DNA, 26 bp, Artificial sequence
  SiRNA target sequence
ttctaaaaaaatatttagaaaataat

SEQ ID NO: 237179 - DNA, 26 bp, Artificial sequence
  SiRNA target sequence
tctaaaaaaatatttagaaaataatg

SEQ ID NO: 237180 - DNA, 26 bp, Artificial sequence
  SiRNA target sequence
ctaaaaaaatatttagaaaataatgt

SEQ ID NO: 237181 - DNA, 26 bp, Artificial sequence
  SiRNA target sequence
taaaaaaatatttagaaaataatgtt

SEQ ID NO: 237182 - DNA, 26 bp, Artificial sequence
  SiRNA target sequence
aaaaaaatatttagaaaataatgtta

SEQ ID NO: 237183 - DNA, 26 bp, Artificial sequence
  SiRNA target sequence
aaaaaatatttagaaaataatgttac

SEQ ID NO: 237184 - DNA, 26 bp, Artificial sequence
  SiRNA target sequence
aaaaatatttagaaaataatgttact

SEQ ID NO: 237185 - DNA, 26 bp, Artificial sequence
  SiRNA target sequence
aaaatatttagaaaataatgttacta

SEQ ID NO: 237186 - DNA, 26 bp, Artificial sequence
  SiRNA target sequence
aaatatttagaaaataatgttactag

SEQ ID NO: 237187 - DNA, 26 bp, Artificial sequence
  SiRNA target sequence
aatatttagaaaataatgttactagc

SEQ ID NO: 237188 - DNA, 26 bp, Artificial sequence
  SiRNA target sequence
atatttagaaaataatgttactagca

SEQ ID NO: 237189 - DNA, 26 bp, Artificial sequence
  SiRNA target sequence
tatttagaaaataatgttactagcaa

SEQ ID NO: 237190 - DNA, 26 bp, Artificial sequence
  SiRNA target sequence
atttagaaaataatgttactagcaaa

SEQ ID NO: 237191 - DNA, 26 bp, Artificial sequence
  SiRNA target sequence
tttagaaaataatgttactagcaaac

SEQ ID NO: 237192 - DNA, 26 bp, Artificial sequence
  SiRNA target sequence
ttagaaaataatgttactagcaaacc

SEQ ID NO: 237193 - DNA, 26 bp, Artificial sequence
  SiRNA target sequence
tagaaaataatgttactagcaaacca

SEQ ID NO: 237194 - DNA, 26 bp, Artificial sequence
  SiRNA target sequence
agaaaataatgttactagcaaaccaa

SEQ ID NO: 237195 - DNA, 26 bp, Artificial sequence
  SiRNA target sequence
gaaaataatgttactagcaaaccaat

SEQ ID NO: 237196 - DNA, 26 bp, Artificial sequence
  SiRNA target sequence
aaaataatgttactagcaaaccaatg

SEQ ID NO: 237197 - DNA, 26 bp, Artificial sequence
  SiRNA target sequence
aaataatgttactagcaaaccaatgt

SEQ ID NO: 237198 - DNA, 26 bp, Artificial sequence
  SiRNA target sequence
aataatgttactagcaaaccaatgtt

SEQ ID NO: 237199 - DNA, 26 bp, Artificial sequence
  SiRNA target sequence
ataatgttactagcaaaccaatgttt

SEQ ID NO: 237200 - DNA, 26 bp, Artificial sequence
  SiRNA target sequence
taatgttactagcaaaccaatgtttg

SEQ ID NO: 237201 - DNA, 26 bp, Artificial sequence
  SiRNA target sequence
aatgttactagcaaaccaatgtttgt

SEQ ID NO: 237202 - DNA, 26 bp, Artificial sequence
  SiRNA target sequence
atgttactagcaaaccaatgtttgtt

SEQ ID NO: 237203 - DNA, 26 bp, Artificial sequence
  SiRNA target sequence
tgttactagcaaaccaatgtttgtta

SEQ ID NO: 237204 - DNA, 26 bp, Artificial sequence
  SiRNA target sequence
gttactagcaaaccaatgtttgttag

SEQ ID NO: 237205 - DNA, 26 bp, Artificial sequence
  SiRNA target sequence
ttactagcaaaccaatgtttgttaga

SEQ ID NO: 237206 - DNA, 26 bp, Artificial sequence
  SiRNA target sequence
tactagcaaaccaatgtttgttagaa

SEQ ID NO: 237207 - DNA, 26 bp, Artificial sequence
  SiRNA target sequence
actagcaaaccaatgtttgttagaaa

SEQ ID NO: 237208 - DNA, 26 bp, Artificial sequence
  SiRNA target sequence
ctagcaaaccaatgtttgttagaaag

SEQ ID NO: 237209 - DNA, 26 bp, Artificial sequence
  SiRNA target sequence
tagcaaaccaatgtttgttagaaaga

SEQ ID NO: 237210 - DNA, 26 bp, Artificial sequence
  SiRNA target sequence
agcaaaccaatgtttgttagaaagac

SEQ ID NO: 237211 - DNA, 26 bp, Artificial sequence
  SiRNA target sequence
gcaaaccaatgtttgttagaaagact

SEQ ID NO: 237212 - DNA, 26 bp, Artificial sequence
  SiRNA target sequence
caaaccaatgtttgttagaaagactt

SEQ ID NO: 237213 - DNA, 26 bp, Artificial sequence
  SiRNA target sequence
aaaccaatgtttgttagaaagacttt

SEQ ID NO: 237214 - DNA, 26 bp, Artificial sequence
  SiRNA target sequence
aaccaatgtttgttagaaagactttt

SEQ ID NO: 237215 - DNA, 26 bp, Artificial sequence
  SiRNA target sequence
accaatgtttgttagaaagactttta

SEQ ID NO: 237216 - DNA, 26 bp, Artificial sequence
  SiRNA target sequence
ccaatgtttgttagaaagacttttac

SEQ ID NO: 237217 - DNA, 26 bp, Artificial sequence
  SiRNA target sequence
caatgtttgttagaaagacttttact

SEQ ID NO: 237218 - DNA, 26 bp, Artificial sequence
  SiRNA target sequence
aatgtttgttagaaagacttttacta

SEQ ID NO: 237219 - DNA, 26 bp, Artificial sequence
  SiRNA target sequence
atgtttgttagaaagacttttactaa

SEQ ID NO: 237220 - DNA, 26 bp, Artificial sequence
  SiRNA target sequence
tgtttgttagaaagacttttactaaa

SEQ ID NO: 237221 - DNA, 26 bp, Artificial sequence
  SiRNA target sequence
gtttgttagaaagacttttactaaaa

SEQ ID NO: 237222 - DNA, 26 bp, Artificial sequence
  SiRNA target sequence
tttgttagaaagacttttactaaaaa

SEQ ID NO: 237223 - DNA, 26 bp, Artificial sequence
  SiRNA target sequence
ttgttagaaagacttttactaaaaag

SEQ ID NO: 237224 - DNA, 26 bp, Artificial sequence
  SiRNA target sequence
tgttagaaagacttttactaaaaaga

SEQ ID NO: 237225 - DNA, 26 bp, Artificial sequence
  SiRNA target sequence
gttagaaagacttttactaaaaagaa

SEQ ID NO: 237226 - DNA, 26 bp, Artificial sequence
  SiRNA target sequence
ttagaaagacttttactaaaaagaag

SEQ ID NO: 237227 - DNA, 26 bp, Artificial sequence
  SiRNA target sequence
tagaaagacttttactaaaaagaaga

SEQ ID NO: 237228 - DNA, 26 bp, Artificial sequence
  SiRNA target sequence
agaaagacttttactaaaaagaagag

SEQ ID NO: 237229 - DNA, 26 bp, Artificial sequence
  SiRNA target sequence
gaaagacttttactaaaaagaagagt

SEQ ID NO: 237230 - DNA, 26 bp, Artificial sequence
  SiRNA target sequence
aaagacttttactaaaaagaagagta

SEQ ID NO: 237231 - DNA, 26 bp, Artificial sequence
  SiRNA target sequence
aagacttttactaaaaagaagagtaa

SEQ ID NO: 237232 - DNA, 26 bp, Artificial sequence
  SiRNA target sequence
agacttttactaaaaagaagagtaaa

SEQ ID NO: 237233 - DNA, 26 bp, Artificial sequence
  SiRNA target sequence
gacttttactaaaaagaagagtaaag

SEQ ID NO: 237234 - DNA, 26 bp, Artificial sequence
  SiRNA target sequence
acttttactaaaaagaagagtaaagt

SEQ ID NO: 237235 - DNA, 26 bp, Artificial sequence
  SiRNA target sequence
cttttactaaaaagaagagtaaagtg

SEQ ID NO: 237236 - DNA, 26 bp, Artificial sequence
  SiRNA target sequence
ttttactaaaaagaagagtaaagtga

SEQ ID NO: 237237 - DNA, 26 bp, Artificial sequence
  SiRNA target sequence
tttactaaaaagaagagtaaagtgaa

SEQ ID NO: 237238 - DNA, 26 bp, Artificial sequence
  SiRNA target sequence
ttactaaaaagaagagtaaagtgaag

SEQ ID NO: 237239 - DNA, 26 bp, Artificial sequence
  SiRNA target sequence
tactaaaaagaagagtaaagtgaagg

SEQ ID NO: 237240 - DNA, 26 bp, Artificial sequence
  SiRNA target sequence
actaaaaagaagagtaaagtgaaggt

SEQ ID NO: 237241 - DNA, 26 bp, Artificial sequence
  SiRNA target sequence
ctaaaaagaagagtaaagtgaaggtt

SEQ ID NO: 237242 - DNA, 26 bp, Artificial sequence
  SiRNA target sequence
taaaaagaagagtaaagtgaaggttg

SEQ ID NO: 237243 - DNA, 26 bp, Artificial sequence
  SiRNA target sequence
aaaaagaagagtaaagtgaaggttgg

SEQ ID NO: 237244 - DNA, 26 bp, Artificial sequence
  SiRNA target sequence
aaaagaagagtaaagtgaaggttgga

SEQ ID NO: 237245 - DNA, 26 bp, Artificial sequence
  SiRNA target sequence
aaagaagagtaaagtgaaggttggat

SEQ ID NO: 237246 - DNA, 26 bp, Artificial sequence
  SiRNA target sequence
aagaagagtaaagtgaaggttggatt

SEQ ID NO: 237247 - DNA, 26 bp, Artificial sequence
  SiRNA target sequence
agaagagtaaagtgaaggttggattt

SEQ ID NO: 237248 - DNA, 26 bp, Artificial sequence
  SiRNA target sequence
gaagagtaaagtgaaggttggatttg

SEQ ID NO: 237249 - DNA, 26 bp, Artificial sequence
  SiRNA target sequence
aagagtaaagtgaaggttggatttgt

SEQ ID NO: 237250 - DNA, 26 bp, Artificial sequence
  SiRNA target sequence
agagtaaagtgaaggttggatttgtt

SEQ ID NO: 237251 - DNA, 26 bp, Artificial sequence
  SiRNA target sequence
gagtaaagtgaaggttggatttgttg

SEQ ID NO: 237252 - DNA, 26 bp, Artificial sequence
  SiRNA target sequence
agtaaagtgaaggttggatttgttga

SEQ ID NO: 237253 - DNA, 26 bp, Artificial sequence
  SiRNA target sequence
gtaaagtgaaggttggatttgttgat

SEQ ID NO: 237254 - DNA, 26 bp, Artificial sequence
  SiRNA target sequence
taaagtgaaggttggatttgttgatg

SEQ ID NO: 237255 - DNA, 26 bp, Artificial sequence
  SiRNA target sequence
aaagtgaaggttggatttgttgatgg

SEQ ID NO: 237256 - DNA, 26 bp, Artificial sequence
  SiRNA target sequence
aagtgaaggttggatttgttgatgga

SEQ ID NO: 237257 - DNA, 26 bp, Artificial sequence
  SiRNA target sequence
agtgaaggttggatttgttgatggac

SEQ ID NO: 237258 - DNA, 26 bp, Artificial sequence
  SiRNA target sequence
gtgaaggttggatttgttgatggact

SEQ ID NO: 237259 - DNA, 26 bp, Artificial sequence
  SiRNA target sequence
tgaaggttggatttgttgatggactt

SEQ ID NO: 237260 - DNA, 26 bp, Artificial sequence
  SiRNA target sequence
gaaggttggatttgttgatggactta

SEQ ID NO: 237261 - DNA, 26 bp, Artificial sequence
  SiRNA target sequence
aaggttggatttgttgatggacttat

SEQ ID NO: 237262 - DNA, 26 bp, Artificial sequence
  SiRNA target sequence
aggttggatttgttgatggacttatt

SEQ ID NO: 237263 - DNA, 26 bp, Artificial sequence
  SiRNA target sequence
ggttggatttgttgatggacttattg

SEQ ID NO: 237264 - DNA, 26 bp, Artificial sequence
  SiRNA target sequence
gttggatttgttgatggacttattga

SEQ ID NO: 237265 - DNA, 26 bp, Artificial sequence
  SiRNA target sequence
ttggatttgttgatggacttattgag

SEQ ID NO: 237266 - DNA, 26 bp, Artificial sequence
  SiRNA target sequence
tggatttgttgatggacttattgaga

SEQ ID NO: 237267 - DNA, 26 bp, Artificial sequence
  SiRNA target sequence
ggatttgttgatggacttattgagat

SEQ ID NO: 237268 - DNA, 26 bp, Artificial sequence
  SiRNA target sequence
gatttgttgatggacttattgagatg

SEQ ID NO: 237269 - DNA, 26 bp, Artificial sequence
  SiRNA target sequence
atttgttgatggacttattgagatga

SEQ ID NO: 237270 - DNA, 26 bp, Artificial sequence
  SiRNA target sequence
tttgttgatggacttattgagatgag

SEQ ID NO: 237271 - DNA, 26 bp, Artificial sequence
  SiRNA target sequence
ttgttgatggacttattgagatgagt

SEQ ID NO: 237272 - DNA, 26 bp, Artificial sequence
  SiRNA target sequence
tgttgatggacttattgagatgagta

SEQ ID NO: 237273 - DNA, 26 bp, Artificial sequence
  SiRNA target sequence
gttgatggacttattgagatgagtaa

SEQ ID NO: 237274 - DNA, 26 bp, Artificial sequence
  SiRNA target sequence
ttgatggacttattgagatgagtaaa

SEQ ID NO: 237275 - DNA, 26 bp, Artificial sequence
  SiRNA target sequence
tgatggacttattgagatgagtaaat

SEQ ID NO: 237276 - DNA, 26 bp, Artificial sequence
  SiRNA target sequence
gatggacttattgagatgagtaaatc

SEQ ID NO: 237277 - DNA, 26 bp, Artificial sequence
  SiRNA target sequence
atggacttattgagatgagtaaatct

SEQ ID NO: 237278 - DNA, 26 bp, Artificial sequence
  SiRNA target sequence
tggacttattgagatgagtaaatcta

SEQ ID NO: 237279 - DNA, 26 bp, Artificial sequence
  SiRNA target sequence
ggacttattgagatgagtaaatctaa

SEQ ID NO: 237280 - DNA, 26 bp, Artificial sequence
  SiRNA target sequence
gacttattgagatgagtaaatctaaa

SEQ ID NO: 237281 - DNA, 26 bp, Artificial sequence
  SiRNA target sequence
acttattgagatgagtaaatctaaac

SEQ ID NO: 237282 - DNA, 26 bp, Artificial sequence
  SiRNA target sequence
cttattgagatgagtaaatctaaact

SEQ ID NO: 237283 - DNA, 26 bp, Artificial sequence
  SiRNA target sequence
ttattgagatgagtaaatctaaacta

SEQ ID NO: 237284 - DNA, 26 bp, Artificial sequence
  SiRNA target sequence
tattgagatgagtaaatctaaactac

SEQ ID NO: 237285 - DNA, 26 bp, Artificial sequence
  SiRNA target sequence
attgagatgagtaaatctaaactact

SEQ ID NO: 237286 - DNA, 26 bp, Artificial sequence
  SiRNA target sequence
ttgagatgagtaaatctaaactactg

SEQ ID NO: 237287 - DNA, 26 bp, Artificial sequence
  SiRNA target sequence
tgagatgagtaaatctaaactactgt

SEQ ID NO: 237288 - DNA, 26 bp, Artificial sequence
  SiRNA target sequence
gagatgagtaaatctaaactactgtt

SEQ ID NO: 237289 - DNA, 26 bp, Artificial sequence
  SiRNA target sequence
agatgagtaaatctaaactactgttg

SEQ ID NO: 237290 - DNA, 26 bp, Artificial sequence
  SiRNA target sequence
gatgagtaaatctaaactactgttga

SEQ ID NO: 237291 - DNA, 26 bp, Artificial sequence
  SiRNA target sequence
atgagtaaatctaaactactgttgaa

SEQ ID NO: 237292 - DNA, 26 bp, Artificial sequence
  SiRNA target sequence
tgagtaaatctaaactactgttgaat

SEQ ID NO: 237293 - DNA, 26 bp, Artificial sequence
  SiRNA target sequence
gagtaaatctaaactactgttgaata

SEQ ID NO: 237294 - DNA, 26 bp, Artificial sequence
  SiRNA target sequence
agtaaatctaaactactgttgaatat

SEQ ID NO: 237295 - DNA, 26 bp, Artificial sequence
  SiRNA target sequence
gtaaatctaaactactgttgaatatg

SEQ ID NO: 237296 - DNA, 26 bp, Artificial sequence
  SiRNA target sequence
taaatctaaactactgttgaatatgt

SEQ ID NO: 237297 - DNA, 26 bp, Artificial sequence
  SiRNA target sequence
aaatctaaactactgttgaatatgtc

SEQ ID NO: 237298 - DNA, 26 bp, Artificial sequence
  SiRNA target sequence
aatctaaactactgttgaatatgtca

SEQ ID NO: 237299 - DNA, 26 bp, Artificial sequence
  SiRNA target sequence
atctaaactactgttgaatatgtcat

SEQ ID NO: 237300 - DNA, 26 bp, Artificial sequence
  SiRNA target sequence
tctaaactactgttgaatatgtcatt

SEQ ID NO: 237301 - DNA, 26 bp, Artificial sequence
  SiRNA target sequence
ctaaactactgttgaatatgtcatta

SEQ ID NO: 237302 - DNA, 26 bp, Artificial sequence
  SiRNA target sequence
taaactactgttgaatatgtcattag

SEQ ID NO: 237303 - DNA, 26 bp, Artificial sequence
  SiRNA target sequence
aaactactgttgaatatgtcattagt

SEQ ID NO: 237304 - DNA, 26 bp, Artificial sequence
  SiRNA target sequence
aactactgttgaatatgtcattagtc

SEQ ID NO: 237305 - DNA, 26 bp, Artificial sequence
  SiRNA target sequence
actactgttgaatatgtcattagtcg

SEQ ID NO: 237306 - DNA, 26 bp, Artificial sequence
  SiRNA target sequence
ctactgttgaatatgtcattagtcgt

SEQ ID NO: 237307 - DNA, 26 bp, Artificial sequence
  SiRNA target sequence
tactgttgaatatgtcattagtcgta

SEQ ID NO: 237308 - DNA, 26 bp, Artificial sequence
  SiRNA target sequence
actgttgaatatgtcattagtcgtat

SEQ ID NO: 237309 - DNA, 26 bp, Artificial sequence
  SiRNA target sequence
ctgttgaatatgtcattagtcgtatt

SEQ ID NO: 237310 - DNA, 26 bp, Artificial sequence
  SiRNA target sequence
tgttgaatatgtcattagtcgtatta

SEQ ID NO: 237311 - DNA, 26 bp, Artificial sequence
  SiRNA target sequence
gttgaatatgtcattagtcgtattat

SEQ ID NO: 237312 - DNA, 26 bp, Artificial sequence
  SiRNA target sequence
ttgaatatgtcattagtcgtattatt

SEQ ID NO: 237313 - DNA, 26 bp, Artificial sequence
  SiRNA target sequence
tgaatatgtcattagtcgtattattt

SEQ ID NO: 237314 - DNA, 26 bp, Artificial sequence
  SiRNA target sequence
gaatatgtcattagtcgtattatttt

SEQ ID NO: 237315 - DNA, 26 bp, Artificial sequence
  SiRNA target sequence
aatatgtcattagtcgtattatttta

SEQ ID NO: 237316 - DNA, 26 bp, Artificial sequence
  SiRNA target sequence
atatgtcattagtcgtattattttat

SEQ ID NO: 237317 - DNA, 26 bp, Artificial sequence
  SiRNA target sequence
tatgtcattagtcgtattattttatg

SEQ ID NO: 237318 - DNA, 26 bp, Artificial sequence
  SiRNA target sequence
atgtcattagtcgtattattttatgc

SEQ ID NO: 237319 - DNA, 26 bp, Artificial sequence
  SiRNA target sequence
tgtcattagtcgtattattttatgct

SEQ ID NO: 237320 - DNA, 26 bp, Artificial sequence
  SiRNA target sequence
gtcattagtcgtattattttatgctg

SEQ ID NO: 237321 - DNA, 26 bp, Artificial sequence
  SiRNA target sequence
tcattagtcgtattattttatgctgt

SEQ ID NO: 237322 - DNA, 26 bp, Artificial sequence
  SiRNA target sequence
cattagtcgtattattttatgctgtt

SEQ ID NO: 237323 - DNA, 26 bp, Artificial sequence
  SiRNA target sequence
attagtcgtattattttatgctgttt

SEQ ID NO: 237324 - DNA, 26 bp, Artificial sequence
  SiRNA target sequence
ttagtcgtattattttatgctgtttc

SEQ ID NO: 237325 - DNA, 26 bp, Artificial sequence
  SiRNA target sequence
tagtcgtattattttatgctgtttct

SEQ ID NO: 237326 - DNA, 26 bp, Artificial sequence
  SiRNA target sequence
agtcgtattattttatgctgtttcta

SEQ ID NO: 237327 - DNA, 26 bp, Artificial sequence
  SiRNA target sequence
gtcgtattattttatgctgtttctac

SEQ ID NO: 237328 - DNA, 26 bp, Artificial sequence
  SiRNA target sequence
tcgtattattttatgctgtttctacg

SEQ ID NO: 237329 - DNA, 26 bp, Artificial sequence
  SiRNA target sequence
cgtattattttatgctgtttctacga

SEQ ID NO: 237330 - DNA, 26 bp, Artificial sequence
  SiRNA target sequence
gtattattttatgctgtttctacgaa

SEQ ID NO: 237331 - DNA, 26 bp, Artificial sequence
  SiRNA target sequence
tattattttatgctgtttctacgaat

SEQ ID NO: 237332 - DNA, 26 bp, Artificial sequence
  SiRNA target sequence
attattttatgctgtttctacgaata

SEQ ID NO: 237333 - DNA, 26 bp, Artificial sequence
  SiRNA target sequence
ttattttatgctgtttctacgaatat

SEQ ID NO: 237334 - DNA, 26 bp, Artificial sequence
  SiRNA target sequence
tattttatgctgtttctacgaatatt

SEQ ID NO: 237335 - DNA, 26 bp, Artificial sequence
  SiRNA target sequence
attttatgctgtttctacgaatatta

SEQ ID NO: 237336 - DNA, 26 bp, Artificial sequence
  SiRNA target sequence
ttttatgctgtttctacgaatattat

SEQ ID NO: 237337 - DNA, 26 bp, Artificial sequence
  SiRNA target sequence
tttatgctgtttctacgaatattatt

SEQ ID NO: 237338 - DNA, 26 bp, Artificial sequence
  SiRNA target sequence
ttatgctgtttctacgaatattattg

SEQ ID NO: 237339 - DNA, 26 bp, Artificial sequence
  SiRNA target sequence
tatgctgtttctacgaatattattga

SEQ ID NO: 237340 - DNA, 26 bp, Artificial sequence
  SiRNA target sequence
atgctgtttctacgaatattattgag

SEQ ID NO: 237341 - DNA, 26 bp, Artificial sequence
  SiRNA target sequence
tgctgtttctacgaatattattgagt

SEQ ID NO: 237342 - DNA, 26 bp, Artificial sequence
  SiRNA target sequence
gctgtttctacgaatattattgagtc

SEQ ID NO: 237343 - DNA, 26 bp, Artificial sequence
  SiRNA target sequence
ctgtttctacgaatattattgagtca

SEQ ID NO: 237344 - DNA, 26 bp, Artificial sequence
  SiRNA target sequence
tgtttctacgaatattattgagtcag

SEQ ID NO: 237345 - DNA, 26 bp, Artificial sequence
  SiRNA target sequence
gtttctacgaatattattgagtcagc

SEQ ID NO: 237346 - DNA, 26 bp, Artificial sequence
  SiRNA target sequence
tttctacgaatattattgagtcagct

SEQ ID NO: 237347 - DNA, 26 bp, Artificial sequence
  SiRNA target sequence
ttctacgaatattattgagtcagctt

SEQ ID NO: 237348 - DNA, 26 bp, Artificial sequence
  SiRNA target sequence
tctacgaatattattgagtcagctta

SEQ ID NO: 237349 - DNA, 26 bp, Artificial sequence
  SiRNA target sequence
ctacgaatattattgagtcagcttat

SEQ ID NO: 237350 - DNA, 26 bp, Artificial sequence
  SiRNA target sequence
tacgaatattattgagtcagcttata

SEQ ID NO: 237351 - DNA, 26 bp, Artificial sequence
  SiRNA target sequence
acgaatattattgagtcagcttataa

SEQ ID NO: 237352 - DNA, 26 bp, Artificial sequence
  SiRNA target sequence
cgaatattattgagtcagcttataaa

SEQ ID NO: 237353 - DNA, 26 bp, Artificial sequence
  SiRNA target sequence
gaatattattgagtcagcttataaat

SEQ ID NO: 237354 - DNA, 26 bp, Artificial sequence
  SiRNA target sequence
aatattattgagtcagcttataaatc

SEQ ID NO: 237355 - DNA, 26 bp, Artificial sequence
  SiRNA target sequence
atattattgagtcagcttataaatct

SEQ ID NO: 237356 - DNA, 26 bp, Artificial sequence
  SiRNA target sequence
tattattgagtcagcttataaatctg

SEQ ID NO: 237357 - DNA, 26 bp, Artificial sequence
  SiRNA target sequence
attattgagtcagcttataaatctgc

SEQ ID NO: 237358 - DNA, 26 bp, Artificial sequence
  SiRNA target sequence
ttattgagtcagcttataaatctgct

SEQ ID NO: 237359 - DNA, 26 bp, Artificial sequence
  SiRNA target sequence
tattgagtcagcttataaatctgctt

SEQ ID NO: 237360 - DNA, 26 bp, Artificial sequence
  SiRNA target sequence
attgagtcagcttataaatctgcttt

SEQ ID NO: 237361 - DNA, 26 bp, Artificial sequence
  SiRNA target sequence
ttgagtcagcttataaatctgcttta

SEQ ID NO: 237362 - DNA, 26 bp, Artificial sequence
  SiRNA target sequence
tgagtcagcttataaatctgctttag

SEQ ID NO: 237363 - DNA, 26 bp, Artificial sequence
  SiRNA target sequence
gagtcagcttataaatctgctttagc

SEQ ID NO: 237364 - DNA, 26 bp, Artificial sequence
  SiRNA target sequence
agtcagcttataaatctgctttagct

SEQ ID NO: 237365 - DNA, 26 bp, Artificial sequence
  SiRNA target sequence
gtcagcttataaatctgctttagctg

SEQ ID NO: 237366 - DNA, 26 bp, Artificial sequence
  SiRNA target sequence
tcagcttataaatctgctttagctgt

SEQ ID NO: 237367 - DNA, 26 bp, Artificial sequence
  SiRNA target sequence
cagcttataaatctgctttagctgtc

SEQ ID NO: 237368 - DNA, 26 bp, Artificial sequence
  SiRNA target sequence
agcttataaatctgctttagctgtcg

SEQ ID NO: 237369 - DNA, 26 bp, Artificial sequence
  SiRNA target sequence
gcttataaatctgctttagctgtcgg

SEQ ID NO: 237370 - DNA, 26 bp, Artificial sequence
  SiRNA target sequence
cttataaatctgctttagctgtcggt

SEQ ID NO: 237371 - DNA, 26 bp, Artificial sequence
  SiRNA target sequence
ttataaatctgctttagctgtcggtg

SEQ ID NO: 237372 - DNA, 26 bp, Artificial sequence
  SiRNA target sequence
tataaatctgctttagctgtcggtgc

SEQ ID NO: 237373 - DNA, 26 bp, Artificial sequence
  SiRNA target sequence
ataaatctgctttagctgtcggtgct

SEQ ID NO: 237374 - DNA, 26 bp, Artificial sequence
  SiRNA target sequence
taaatctgctttagctgtcggtgcta

SEQ ID NO: 237375 - DNA, 26 bp, Artificial sequence
  SiRNA target sequence
aaatctgctttagctgtcggtgctaa

SEQ ID NO: 237376 - DNA, 26 bp, Artificial sequence
  SiRNA target sequence
aatctgctttagctgtcggtgctaat

SEQ ID NO: 237377 - DNA, 26 bp, Artificial sequence
  SiRNA target sequence
atctgctttagctgtcggtgctaatg

SEQ ID NO: 237378 - DNA, 26 bp, Artificial sequence
  SiRNA target sequence
tctgctttagctgtcggtgctaatga

SEQ ID NO: 237379 - DNA, 26 bp, Artificial sequence
  SiRNA target sequence
ctgctttagctgtcggtgctaatgaa

SEQ ID NO: 237380 - DNA, 26 bp, Artificial sequence
  SiRNA target sequence
tgctttagctgtcggtgctaatgaaa

SEQ ID NO: 237381 - DNA, 26 bp, Artificial sequence
  SiRNA target sequence
gctttagctgtcggtgctaatgaaac

SEQ ID NO: 237382 - DNA, 26 bp, Artificial sequence
  SiRNA target sequence
ctttagctgtcggtgctaatgaaact

SEQ ID NO: 237383 - DNA, 26 bp, Artificial sequence
  SiRNA target sequence
tttagctgtcggtgctaatgaaactg

SEQ ID NO: 237384 - DNA, 26 bp, Artificial sequence
  SiRNA target sequence
ttagctgtcggtgctaatgaaactgg

SEQ ID NO: 237385 - DNA, 26 bp, Artificial sequence
  SiRNA target sequence
tagctgtcggtgctaatgaaactggt

SEQ ID NO: 237386 - DNA, 26 bp, Artificial sequence
  SiRNA target sequence
agctgtcggtgctaatgaaactggtg

SEQ ID NO: 237387 - DNA, 26 bp, Artificial sequence
  SiRNA target sequence
gctgtcggtgctaatgaaactggtga

SEQ ID NO: 237388 - DNA, 26 bp, Artificial sequence
  SiRNA target sequence
ctgtcggtgctaatgaaactggtgag

SEQ ID NO: 237389 - DNA, 26 bp, Artificial sequence
  SiRNA target sequence
tgtcggtgctaatgaaactggtgagg

SEQ ID NO: 237390 - DNA, 26 bp, Artificial sequence
  SiRNA target sequence
gtcggtgctaatgaaactggtgaggc

SEQ ID NO: 237391 - DNA, 26 bp, Artificial sequence
  SiRNA target sequence
tcggtgctaatgaaactggtgaggca

SEQ ID NO: 237392 - DNA, 26 bp, Artificial sequence
  SiRNA target sequence
cggtgctaatgaaactggtgaggcaa

SEQ ID NO: 237393 - DNA, 26 bp, Artificial sequence
  SiRNA target sequence
ggtgctaatgaaactggtgaggcaaa

SEQ ID NO: 237394 - DNA, 26 bp, Artificial sequence
  SiRNA target sequence
gtgctaatgaaactggtgaggcaaaa

SEQ ID NO: 237395 - DNA, 26 bp, Artificial sequence
  SiRNA target sequence
tgctaatgaaactggtgaggcaaaat

SEQ ID NO: 237396 - DNA, 26 bp, Artificial sequence
  SiRNA target sequence
gctaatgaaactggtgaggcaaaatc

SEQ ID NO: 237397 - DNA, 26 bp, Artificial sequence
  SiRNA target sequence
ctaatgaaactggtgaggcaaaatct

SEQ ID NO: 237398 - DNA, 26 bp, Artificial sequence
  SiRNA target sequence
taatgaaactggtgaggcaaaatcta

SEQ ID NO: 237399 - DNA, 26 bp, Artificial sequence
  SiRNA target sequence
aatgaaactggtgaggcaaaatctac

SEQ ID NO: 237400 - DNA, 26 bp, Artificial sequence
  SiRNA target sequence
atgaaactggtgaggcaaaatctacc

SEQ ID NO: 237401 - DNA, 26 bp, Artificial sequence
  SiRNA target sequence
tgaaactggtgaggcaaaatctacct

SEQ ID NO: 237402 - DNA, 26 bp, Artificial sequence
  SiRNA target sequence
gaaactggtgaggcaaaatctaccta

SEQ ID NO: 237403 - DNA, 26 bp, Artificial sequence
  SiRNA target sequence
aaactggtgaggcaaaatctacctat

SEQ ID NO: 237404 - DNA, 26 bp, Artificial sequence
  SiRNA target sequence
aactggtgaggcaaaatctacctatg

SEQ ID NO: 237405 - DNA, 26 bp, Artificial sequence
  SiRNA target sequence
actggtgaggcaaaatctacctatgc

SEQ ID NO: 237406 - DNA, 26 bp, Artificial sequence
  SiRNA target sequence
ctggtgaggcaaaatctacctatgct

SEQ ID NO: 237407 - DNA, 26 bp, Artificial sequence
  SiRNA target sequence
tggtgaggcaaaatctacctatgctt

SEQ ID NO: 237408 - DNA, 26 bp, Artificial sequence
  SiRNA target sequence
ggtgaggcaaaatctacctatgcttc

SEQ ID NO: 237409 - DNA, 26 bp, Artificial sequence
  SiRNA target sequence
gtgaggcaaaatctacctatgcttca

SEQ ID NO: 237410 - DNA, 26 bp, Artificial sequence
  SiRNA target sequence
tgaggcaaaatctacctatgcttcaa

SEQ ID NO: 237411 - DNA, 26 bp, Artificial sequence
  SiRNA target sequence
gaggcaaaatctacctatgcttcaat

SEQ ID NO: 237412 - DNA, 26 bp, Artificial sequence
  SiRNA target sequence
aggcaaaatctacctatgcttcaatt

SEQ ID NO: 237413 - DNA, 26 bp, Artificial sequence
  SiRNA target sequence
ggcaaaatctacctatgcttcaattt

SEQ ID NO: 237414 - DNA, 26 bp, Artificial sequence
  SiRNA target sequence
gcaaaatctacctatgcttcaattta

SEQ ID NO: 237415 - DNA, 26 bp, Artificial sequence
  SiRNA target sequence
caaaatctacctatgcttcaatttat

SEQ ID NO: 237416 - DNA, 26 bp, Artificial sequence
  SiRNA target sequence
aaaatctacctatgcttcaatttata

SEQ ID NO: 237417 - DNA, 26 bp, Artificial sequence
  SiRNA target sequence
aaatctacctatgcttcaatttatac

SEQ ID NO: 237418 - DNA, 26 bp, Artificial sequence
  SiRNA target sequence
aatctacctatgcttcaatttataca

SEQ ID NO: 237419 - DNA, 26 bp, Artificial sequence
  SiRNA target sequence
atctacctatgcttcaatttatacat

SEQ ID NO: 237420 - DNA, 26 bp, Artificial sequence
  SiRNA target sequence
tctacctatgcttcaatttatacatc

SEQ ID NO: 237421 - DNA, 26 bp, Artificial sequence
  SiRNA target sequence
ctacctatgcttcaatttatacatca

SEQ ID NO: 237422 - DNA, 26 bp, Artificial sequence
  SiRNA target sequence
tacctatgcttcaatttatacatcaa

SEQ ID NO: 237423 - DNA, 26 bp, Artificial sequence
  SiRNA target sequence
acctatgcttcaatttatacatcaat

SEQ ID NO: 237424 - DNA, 26 bp, Artificial sequence
  SiRNA target sequence
cctatgcttcaatttatacatcaatt

SEQ ID NO: 237425 - DNA, 26 bp, Artificial sequence
  SiRNA target sequence
ctatgcttcaatttatacatcaattg

SEQ ID NO: 237426 - DNA, 26 bp, Artificial sequence
  SiRNA target sequence
tatgcttcaatttatacatcaattga

SEQ ID NO: 237427 - DNA, 26 bp, Artificial sequence
  SiRNA target sequence
atgcttcaatttatacatcaattgaa

SEQ ID NO: 237428 - DNA, 26 bp, Artificial sequence
  SiRNA target sequence
tgcttcaatttatacatcaattgaac

SEQ ID NO: 237429 - DNA, 26 bp, Artificial sequence
  SiRNA target sequence
gcttcaatttatacatcaattgaaca

SEQ ID NO: 237430 - DNA, 26 bp, Artificial sequence
  SiRNA target sequence
cttcaatttatacatcaattgaacaa

SEQ ID NO: 237431 - DNA, 26 bp, Artificial sequence
  SiRNA target sequence
ttcaatttatacatcaattgaacaat

SEQ ID NO: 237432 - DNA, 26 bp, Artificial sequence
  SiRNA target sequence
tcaatttatacatcaattgaacaatc

SEQ ID NO: 237433 - DNA, 26 bp, Artificial sequence
  SiRNA target sequence
caatttatacatcaattgaacaatct

SEQ ID NO: 237434 - DNA, 26 bp, Artificial sequence
  SiRNA target sequence
aatttatacatcaattgaacaatctg

SEQ ID NO: 237435 - DNA, 26 bp, Artificial sequence
  SiRNA target sequence
atttatacatcaattgaacaatctgg

SEQ ID NO: 237436 - DNA, 26 bp, Artificial sequence
  SiRNA target sequence
tttatacatcaattgaacaatctgga

SEQ ID NO: 237437 - DNA, 26 bp, Artificial sequence
  SiRNA target sequence
ttatacatcaattgaacaatctggag

SEQ ID NO: 237438 - DNA, 26 bp, Artificial sequence
  SiRNA target sequence
tatacatcaattgaacaatctggagt

SEQ ID NO: 237439 - DNA, 26 bp, Artificial sequence
  SiRNA target sequence
atacatcaattgaacaatctggagtt

SEQ ID NO: 237440 - DNA, 26 bp, Artificial sequence
  SiRNA target sequence
tacatcaattgaacaatctggagttg

SEQ ID NO: 237441 - DNA, 26 bp, Artificial sequence
  SiRNA target sequence
acatcaattgaacaatctggagttgc

SEQ ID NO: 237442 - DNA, 26 bp, Artificial sequence
  SiRNA target sequence
catcaattgaacaatctggagttgct

SEQ ID NO: 237443 - DNA, 26 bp, Artificial sequence
  SiRNA target sequence
atcaattgaacaatctggagttgctg

SEQ ID NO: 237444 - DNA, 26 bp, Artificial sequence
  SiRNA target sequence
tcaattgaacaatctggagttgctgt

SEQ ID NO: 237445 - DNA, 26 bp, Artificial sequence
  SiRNA target sequence
caattgaacaatctggagttgctgtt

SEQ ID NO: 237446 - DNA, 26 bp, Artificial sequence
  SiRNA target sequence
aattgaacaatctggagttgctgtta

SEQ ID NO: 237447 - DNA, 26 bp, Artificial sequence
  SiRNA target sequence
attgaacaatctggagttgctgttat

SEQ ID NO: 237448 - DNA, 26 bp, Artificial sequence
  SiRNA target sequence
ttgaacaatctggagttgctgttatt

SEQ ID NO: 237449 - DNA, 26 bp, Artificial sequence
  SiRNA target sequence
tgaacaatctggagttgctgttattg

SEQ ID NO: 237450 - DNA, 26 bp, Artificial sequence
  SiRNA target sequence
gaacaatctggagttgctgttattgt

SEQ ID NO: 237451 - DNA, 26 bp, Artificial sequence
  SiRNA target sequence
aacaatctggagttgctgttattgtc

SEQ ID NO: 237452 - DNA, 26 bp, Artificial sequence
  SiRNA target sequence
acaatctggagttgctgttattgtca

SEQ ID NO: 237453 - DNA, 26 bp, Artificial sequence
  SiRNA target sequence
caatctggagttgctgttattgtcat

SEQ ID NO: 237454 - DNA, 26 bp, Artificial sequence
  SiRNA target sequence
aatctggagttgctgttattgtcatg

SEQ ID NO: 237455 - DNA, 26 bp, Artificial sequence
  SiRNA target sequence
atctggagttgctgttattgtcatga

SEQ ID NO: 237456 - DNA, 26 bp, Artificial sequence
  SiRNA target sequence
tctggagttgctgttattgtcatgat

SEQ ID NO: 237457 - DNA, 26 bp, Artificial sequence
  SiRNA target sequence
ctggagttgctgttattgtcatgatt

SEQ ID NO: 237458 - DNA, 26 bp, Artificial sequence
  SiRNA target sequence
tggagttgctgttattgtcatgattt

SEQ ID NO: 237459 - DNA, 26 bp, Artificial sequence
  SiRNA target sequence
ggagttgctgttattgtcatgatttt

SEQ ID NO: 237460 - DNA, 26 bp, Artificial sequence
  SiRNA target sequence
gagttgctgttattgtcatgattttg

SEQ ID NO: 237461 - DNA, 26 bp, Artificial sequence
  SiRNA target sequence
agttgctgttattgtcatgattttgc

SEQ ID NO: 237462 - DNA, 26 bp, Artificial sequence
  SiRNA target sequence
gttgctgttattgtcatgattttgct

SEQ ID NO: 237463 - DNA, 26 bp, Artificial sequence
  SiRNA target sequence
ttgctgttattgtcatgattttgcta

SEQ ID NO: 237464 - DNA, 26 bp, Artificial sequence
  SiRNA target sequence
tgctgttattgtcatgattttgctac

SEQ ID NO: 237465 - DNA, 26 bp, Artificial sequence
  SiRNA target sequence
gctgttattgtcatgattttgctact

SEQ ID NO: 237466 - DNA, 26 bp, Artificial sequence
  SiRNA target sequence
ctgttattgtcatgattttgctactt

SEQ ID NO: 237467 - DNA, 26 bp, Artificial sequence
  SiRNA target sequence
tgttattgtcatgattttgctactta

SEQ ID NO: 237468 - DNA, 26 bp, Artificial sequence
  SiRNA target sequence
gttattgtcatgattttgctacttac

SEQ ID NO: 237469 - DNA, 26 bp, Artificial sequence
  SiRNA target sequence
ttattgtcatgattttgctacttacc

SEQ ID NO: 237470 - DNA, 26 bp, Artificial sequence
  SiRNA target sequence
tattgtcatgattttgctacttaccc

SEQ ID NO: 237471 - DNA, 26 bp, Artificial sequence
  SiRNA target sequence
attgtcatgattttgctacttacccc

SEQ ID NO: 237472 - DNA, 26 bp, Artificial sequence
  SiRNA target sequence
ttgtcatgattttgctacttacccct

SEQ ID NO: 237473 - DNA, 26 bp, Artificial sequence
  SiRNA target sequence
tgtcatgattttgctacttacccctt

SEQ ID NO: 237474 - DNA, 26 bp, Artificial sequence
  SiRNA target sequence
gtcatgattttgctacttaccccttt

SEQ ID NO: 237475 - DNA, 26 bp, Artificial sequence
  SiRNA target sequence
tcatgattttgctacttacccctttt

SEQ ID NO: 237476 - DNA, 26 bp, Artificial sequence
  SiRNA target sequence
catgattttgctacttaccccttttc

SEQ ID NO: 237477 - DNA, 26 bp, Artificial sequence
  SiRNA target sequence
atgattttgctacttaccccttttcc

SEQ ID NO: 237478 - DNA, 26 bp, Artificial sequence
  SiRNA target sequence
tgattttgctacttaccccttttcca

SEQ ID NO: 237479 - DNA, 26 bp, Artificial sequence
  SiRNA target sequence
gattttgctacttaccccttttccaa

SEQ ID NO: 237480 - DNA, 26 bp, Artificial sequence
  SiRNA target sequence
attttgctacttaccccttttccaag

SEQ ID NO: 237481 - DNA, 26 bp, Artificial sequence
  SiRNA target sequence
ttttgctacttaccccttttccaagg

SEQ ID NO: 237482 - DNA, 26 bp, Artificial sequence
  SiRNA target sequence
tttgctacttaccccttttccaaggc

SEQ ID NO: 237483 - DNA, 26 bp, Artificial sequence
  SiRNA target sequence
ttgctacttaccccttttccaaggct

SEQ ID NO: 237484 - DNA, 26 bp, Artificial sequence
  SiRNA target sequence
tgctacttaccccttttccaaggctt

SEQ ID NO: 237485 - DNA, 26 bp, Artificial sequence
  SiRNA target sequence
gctacttaccccttttccaaggctta

SEQ ID NO: 237486 - DNA, 26 bp, Artificial sequence
  SiRNA target sequence
ctacttaccccttttccaaggcttat

SEQ ID NO: 237487 - DNA, 26 bp, Artificial sequence
  SiRNA target sequence
tacttaccccttttccaaggcttatt

SEQ ID NO: 237488 - DNA, 26 bp, Artificial sequence
  SiRNA target sequence
acttaccccttttccaaggcttatta

SEQ ID NO: 237489 - DNA, 26 bp, Artificial sequence
  SiRNA target sequence
cttaccccttttccaaggcttattaa

SEQ ID NO: 237490 - DNA, 26 bp, Artificial sequence
  SiRNA target sequence
ttaccccttttccaaggcttattaaa

SEQ ID NO: 237491 - DNA, 26 bp, Artificial sequence
  SiRNA target sequence
taccccttttccaaggcttattaaaa

SEQ ID NO: 237492 - DNA, 26 bp, Artificial sequence
  SiRNA target sequence
accccttttccaaggcttattaaaac

SEQ ID NO: 237493 - DNA, 26 bp, Artificial sequence
  SiRNA target sequence
ccccttttccaaggcttattaaaaca

SEQ ID NO: 237494 - DNA, 26 bp, Artificial sequence
  SiRNA target sequence
cccttttccaaggcttattaaaacaa

SEQ ID NO: 237495 - DNA, 26 bp, Artificial sequence
  SiRNA target sequence
ccttttccaaggcttattaaaacaaa

SEQ ID NO: 237496 - DNA, 26 bp, Artificial sequence
  SiRNA target sequence
cttttccaaggcttattaaaacaaaa

SEQ ID NO: 237497 - DNA, 26 bp, Artificial sequence
  SiRNA target sequence
ttttccaaggcttattaaaacaaaag

SEQ ID NO: 237498 - DNA, 26 bp, Artificial sequence
  SiRNA target sequence
tttccaaggcttattaaaacaaaagg

SEQ ID NO: 237499 - DNA, 26 bp, Artificial sequence
  SiRNA target sequence
ttccaaggcttattaaaacaaaagga

SEQ ID NO: 237500 - DNA, 26 bp, Artificial sequence
  SiRNA target sequence
tccaaggcttattaaaacaaaaggat

SEQ ID NO: 237501 - DNA, 26 bp, Artificial sequence
  SiRNA target sequence
ccaaggcttattaaaacaaaaggatg

SEQ ID NO: 237502 - DNA, 26 bp, Artificial sequence
  SiRNA target sequence
caaggcttattaaaacaaaaggatgg

SEQ ID NO: 237503 - DNA, 26 bp, Artificial sequence
  SiRNA target sequence
aaggcttattaaaacaaaaggatgga

SEQ ID NO: 237504 - DNA, 26 bp, Artificial sequence
  SiRNA target sequence
aggcttattaaaacaaaaggatggat

SEQ ID NO: 237505 - DNA, 26 bp, Artificial sequence
  SiRNA target sequence
ggcttattaaaacaaaaggatggatt

SEQ ID NO: 237506 - DNA, 26 bp, Artificial sequence
  SiRNA target sequence
gcttattaaaacaaaaggatggatta

SEQ ID NO: 237507 - DNA, 26 bp, Artificial sequence
  SiRNA target sequence
cttattaaaacaaaaggatggattac

SEQ ID NO: 237508 - DNA, 26 bp, Artificial sequence
  SiRNA target sequence
ttattaaaacaaaaggatggattaca

SEQ ID NO: 237509 - DNA, 26 bp, Artificial sequence
  SiRNA target sequence
tattaaaacaaaaggatggattacaa

SEQ ID NO: 237510 - DNA, 26 bp, Artificial sequence
  SiRNA target sequence
attaaaacaaaaggatggattacaat

SEQ ID NO: 237511 - DNA, 26 bp, Artificial sequence
  SiRNA target sequence
ttaaaacaaaaggatggattacaata

SEQ ID NO: 237512 - DNA, 26 bp, Artificial sequence
  SiRNA target sequence
taaaacaaaaggatggattacaatag

SEQ ID NO: 237513 - DNA, 26 bp, Artificial sequence
  SiRNA target sequence
aaaacaaaaggatggattacaatagc

SEQ ID NO: 237514 - DNA, 26 bp, Artificial sequence
  SiRNA target sequence
aaacaaaaggatggattacaatagcc

SEQ ID NO: 237515 - DNA, 26 bp, Artificial sequence
  SiRNA target sequence
aacaaaaggatggattacaatagcca

SEQ ID NO: 237516 - DNA, 26 bp, Artificial sequence
  SiRNA target sequence
acaaaaggatggattacaatagccat

SEQ ID NO: 237517 - DNA, 26 bp, Artificial sequence
  SiRNA target sequence
caaaaggatggattacaatagccatt

SEQ ID NO: 237518 - DNA, 26 bp, Artificial sequence
  SiRNA target sequence
aaaaggatggattacaatagccattc

SEQ ID NO: 237519 - DNA, 26 bp, Artificial sequence
  SiRNA target sequence
aaaggatggattacaatagccattct

SEQ ID NO: 237520 - DNA, 26 bp, Artificial sequence
  SiRNA target sequence
aaggatggattacaatagccattcta

SEQ ID NO: 237521 - DNA, 26 bp, Artificial sequence
  SiRNA target sequence
aggatggattacaatagccattctat

SEQ ID NO: 237522 - DNA, 26 bp, Artificial sequence
  SiRNA target sequence
ggatggattacaatagccattctatg

SEQ ID NO: 237523 - DNA, 26 bp, Artificial sequence
  SiRNA target sequence
gatggattacaatagccattctatgt

SEQ ID NO: 237524 - DNA, 26 bp, Artificial sequence
  SiRNA target sequence
atggattacaatagccattctatgtc

SEQ ID NO: 237525 - DNA, 26 bp, Artificial sequence
  SiRNA target sequence
tggattacaatagccattctatgtcc

SEQ ID NO: 237526 - DNA, 26 bp, Artificial sequence
  SiRNA target sequence
ggattacaatagccattctatgtcct

SEQ ID NO: 237527 - DNA, 26 bp, Artificial sequence
  SiRNA target sequence
gattacaatagccattctatgtccta

SEQ ID NO: 237528 - DNA, 26 bp, Artificial sequence
  SiRNA target sequence
attacaatagccattctatgtcctat

SEQ ID NO: 237529 - DNA, 26 bp, Artificial sequence
  SiRNA target sequence
ttacaatagccattctatgtcctatt

SEQ ID NO: 237530 - DNA, 26 bp, Artificial sequence
  SiRNA target sequence
tacaatagccattctatgtcctatta

SEQ ID NO: 237531 - DNA, 26 bp, Artificial sequence
  SiRNA target sequence
acaatagccattctatgtcctattat

SEQ ID NO: 237532 - DNA, 26 bp, Artificial sequence
  SiRNA target sequence
caatagccattctatgtcctattatt

SEQ ID NO: 237533 - DNA, 26 bp, Artificial sequence
  SiRNA target sequence
aatagccattctatgtcctattatta

SEQ ID NO: 237534 - DNA, 26 bp, Artificial sequence
  SiRNA target sequence
atagccattctatgtcctattattac

SEQ ID NO: 237535 - DNA, 26 bp, Artificial sequence
  SiRNA target sequence
tagccattctatgtcctattattact

SEQ ID NO: 237536 - DNA, 26 bp, Artificial sequence
  SiRNA target sequence
agccattctatgtcctattattactt

SEQ ID NO: 237537 - DNA, 26 bp, Artificial sequence
  SiRNA target sequence
gccattctatgtcctattattacttt

SEQ ID NO: 237538 - DNA, 26 bp, Artificial sequence
  SiRNA target sequence
ccattctatgtcctattattactttt

SEQ ID NO: 237539 - DNA, 26 bp, Artificial sequence
  SiRNA target sequence
cattctatgtcctattattacttttt

SEQ ID NO: 237540 - DNA, 26 bp, Artificial sequence
  SiRNA target sequence
attctatgtcctattattactttttt

SEQ ID NO: 237541 - DNA, 26 bp, Artificial sequence
  SiRNA target sequence
ttctatgtcctattattacttttttt

SEQ ID NO: 237542 - DNA, 26 bp, Artificial sequence
  SiRNA target sequence
tctatgtcctattattactttttttt

SEQ ID NO: 237543 - DNA, 26 bp, Artificial sequence
  SiRNA target sequence
ctatgtcctattattacttttttttc

SEQ ID NO: 237544 - DNA, 26 bp, Artificial sequence
  SiRNA target sequence
tatgtcctattattacttttttttct

SEQ ID NO: 237545 - DNA, 26 bp, Artificial sequence
  SiRNA target sequence
atgtcctattattacttttttttctg

SEQ ID NO: 237546 - DNA, 26 bp, Artificial sequence
  SiRNA target sequence
tgtcctattattacttttttttctgc

SEQ ID NO: 237547 - DNA, 26 bp, Artificial sequence
  SiRNA target sequence
gtcctattattacttttttttctgct

SEQ ID NO: 237548 - DNA, 26 bp, Artificial sequence
  SiRNA target sequence
tcctattattacttttttttctgctt

SEQ ID NO: 237549 - DNA, 26 bp, Artificial sequence
  SiRNA target sequence
cctattattacttttttttctgcttt

SEQ ID NO: 237550 - DNA, 26 bp, Artificial sequence
  SiRNA target sequence
ctattattacttttttttctgctttt

SEQ ID NO: 237551 - DNA, 26 bp, Artificial sequence
  SiRNA target sequence
tattattacttttttttctgcttttg

SEQ ID NO: 237552 - DNA, 26 bp, Artificial sequence
  SiRNA target sequence
attattacttttttttctgcttttgg

SEQ ID NO: 237553 - DNA, 26 bp, Artificial sequence
  SiRNA target sequence
ttattacttttttttctgcttttggt

SEQ ID NO: 237554 - DNA, 26 bp, Artificial sequence
  SiRNA target sequence
tattacttttttttctgcttttggta

SEQ ID NO: 237555 - DNA, 26 bp, Artificial sequence
  SiRNA target sequence
attacttttttttctgcttttggtac

SEQ ID NO: 237556 - DNA, 26 bp, Artificial sequence
  SiRNA target sequence
ttacttttttttctgcttttggtact

SEQ ID NO: 237557 - DNA, 26 bp, Artificial sequence
  SiRNA target sequence
tacttttttttctgcttttggtactt

SEQ ID NO: 237558 - DNA, 26 bp, Artificial sequence
  SiRNA target sequence
acttttttttctgcttttggtacttt

SEQ ID NO: 237559 - DNA, 26 bp, Artificial sequence
  SiRNA target sequence
cttttttttctgcttttggtactttt

SEQ ID NO: 237560 - DNA, 26 bp, Artificial sequence
  SiRNA target sequence
ttttttttctgcttttggtacttttg

SEQ ID NO: 237561 - DNA, 26 bp, Artificial sequence
  SiRNA target sequence
tttttttctgcttttggtacttttgt

SEQ ID NO: 237562 - DNA, 26 bp, Artificial sequence
  SiRNA target sequence
ttttttctgcttttggtacttttgta

SEQ ID NO: 237563 - DNA, 26 bp, Artificial sequence
  SiRNA target sequence
tttttctgcttttggtacttttgtat

SEQ ID NO: 237564 - DNA, 26 bp, Artificial sequence
  SiRNA target sequence
ttttctgcttttggtacttttgtatt

SEQ ID NO: 237565 - DNA, 26 bp, Artificial sequence
  SiRNA target sequence
tttctgcttttggtacttttgtatta

SEQ ID NO: 237566 - DNA, 26 bp, Artificial sequence
  SiRNA target sequence
ttctgcttttggtacttttgtattag

SEQ ID NO: 237567 - DNA, 26 bp, Artificial sequence
  SiRNA target sequence
tctgcttttggtacttttgtattagc

SEQ ID NO: 237568 - DNA, 26 bp, Artificial sequence
  SiRNA target sequence
ctgcttttggtacttttgtattagct

SEQ ID NO: 237569 - DNA, 26 bp, Artificial sequence
  SiRNA target sequence
tgcttttggtacttttgtattagctt

SEQ ID NO: 237570 - DNA, 26 bp, Artificial sequence
  SiRNA target sequence
gcttttggtacttttgtattagctta

SEQ ID NO: 237571 - DNA, 26 bp, Artificial sequence
  SiRNA target sequence
cttttggtacttttgtattagcttat

SEQ ID NO: 237572 - DNA, 26 bp, Artificial sequence
  SiRNA target sequence
ttttggtacttttgtattagcttatt

SEQ ID NO: 237573 - DNA, 26 bp, Artificial sequence
  SiRNA target sequence
tttggtacttttgtattagcttattt

SEQ ID NO: 237574 - DNA, 26 bp, Artificial sequence
  SiRNA target sequence
ttggtacttttgtattagcttattta

SEQ ID NO: 237575 - DNA, 26 bp, Artificial sequence
  SiRNA target sequence
tggtacttttgtattagcttatttaa

SEQ ID NO: 237576 - DNA, 26 bp, Artificial sequence
  SiRNA target sequence
ggtacttttgtattagcttatttaaa

SEQ ID NO: 237577 - DNA, 26 bp, Artificial sequence
  SiRNA target sequence
gtacttttgtattagcttatttaaac

SEQ ID NO: 237578 - DNA, 26 bp, Artificial sequence
  SiRNA target sequence
tacttttgtattagcttatttaaact

SEQ ID NO: 237579 - DNA, 26 bp, Artificial sequence
  SiRNA target sequence
acttttgtattagcttatttaaactt

SEQ ID NO: 237580 - DNA, 26 bp, Artificial sequence
  SiRNA target sequence
cttttgtattagcttatttaaacttc

SEQ ID NO: 237581 - DNA, 26 bp, Artificial sequence
  SiRNA target sequence
ttttgtattagcttatttaaacttcc

SEQ ID NO: 237582 - DNA, 26 bp, Artificial sequence
  SiRNA target sequence
tttgtattagcttatttaaacttccc

SEQ ID NO: 237583 - DNA, 26 bp, Artificial sequence
  SiRNA target sequence
ttgtattagcttatttaaacttccca

SEQ ID NO: 237584 - DNA, 26 bp, Artificial sequence
  SiRNA target sequence
tgtattagcttatttaaacttcccaa

SEQ ID NO: 237585 - DNA, 26 bp, Artificial sequence
  SiRNA target sequence
gtattagcttatttaaacttcccaat

SEQ ID NO: 237586 - DNA, 26 bp, Artificial sequence
  SiRNA target sequence
tattagcttatttaaacttcccaatt

SEQ ID NO: 237587 - DNA, 26 bp, Artificial sequence
  SiRNA target sequence
attagcttatttaaacttcccaatta

SEQ ID NO: 237588 - DNA, 26 bp, Artificial sequence
  SiRNA target sequence
ttagcttatttaaacttcccaattac

SEQ ID NO: 237589 - DNA, 26 bp, Artificial sequence
  SiRNA target sequence
tagcttatttaaacttcccaattaca

SEQ ID NO: 237590 - DNA, 26 bp, Artificial sequence
  SiRNA target sequence
agcttatttaaacttcccaattacaa

SEQ ID NO: 237591 - DNA, 26 bp, Artificial sequence
  SiRNA target sequence
gcttatttaaacttcccaattacaaa

SEQ ID NO: 237592 - DNA, 26 bp, Artificial sequence
  SiRNA target sequence
cttatttaaacttcccaattacaaac

SEQ ID NO: 237593 - DNA, 26 bp, Artificial sequence
  SiRNA target sequence
ttatttaaacttcccaattacaaaca

SEQ ID NO: 237594 - DNA, 26 bp, Artificial sequence
  SiRNA target sequence
tatttaaacttcccaattacaaacaa

SEQ ID NO: 237595 - DNA, 26 bp, Artificial sequence
  SiRNA target sequence
atttaaacttcccaattacaaacaaa

SEQ ID NO: 237596 - DNA, 26 bp, Artificial sequence
  SiRNA target sequence
tttaaacttcccaattacaaacaaag

SEQ ID NO: 237597 - DNA, 26 bp, Artificial sequence
  SiRNA target sequence
ttaaacttcccaattacaaacaaaga

SEQ ID NO: 237598 - DNA, 26 bp, Artificial sequence
  SiRNA target sequence
taaacttcccaattacaaacaaagag

SEQ ID NO: 237599 - DNA, 26 bp, Artificial sequence
  SiRNA target sequence
aaacttcccaattacaaacaaagagg

SEQ ID NO: 237600 - DNA, 26 bp, Artificial sequence
  SiRNA target sequence
aacttcccaattacaaacaaagagga

SEQ ID NO: 237601 - DNA, 26 bp, Artificial sequence
  SiRNA target sequence
acttcccaattacaaacaaagaggat

SEQ ID NO: 237602 - DNA, 26 bp, Artificial sequence
  SiRNA target sequence
cttcccaattacaaacaaagaggata

SEQ ID NO: 237603 - DNA, 26 bp, Artificial sequence
  SiRNA target sequence
ttcccaattacaaacaaagaggataa

SEQ ID NO: 237604 - DNA, 26 bp, Artificial sequence
  SiRNA target sequence
tcccaattacaaacaaagaggataat

SEQ ID NO: 237605 - DNA, 26 bp, Artificial sequence
  SiRNA target sequence
cccaattacaaacaaagaggataata

SEQ ID NO: 237606 - DNA, 26 bp, Artificial sequence
  SiRNA target sequence
ccaattacaaacaaagaggataatat

SEQ ID NO: 237607 - DNA, 26 bp, Artificial sequence
  SiRNA target sequence
caattacaaacaaagaggataatata

SEQ ID NO: 237608 - DNA, 26 bp, Artificial sequence
  SiRNA target sequence
aattacaaacaaagaggataatatat

SEQ ID NO: 237609 - DNA, 26 bp, Artificial sequence
  SiRNA target sequence
attacaaacaaagaggataatatatt

SEQ ID NO: 237610 - DNA, 26 bp, Artificial sequence
  SiRNA target sequence
ttacaaacaaagaggataatatattt

SEQ ID NO: 237611 - DNA, 26 bp, Artificial sequence
  SiRNA target sequence
tacaaacaaagaggataatatatttg

SEQ ID NO: 237612 - DNA, 26 bp, Artificial sequence
  SiRNA target sequence
acaaacaaagaggataatatatttga

SEQ ID NO: 237613 - DNA, 26 bp, Artificial sequence
  SiRNA target sequence
caaacaaagaggataatatatttgat

SEQ ID NO: 237614 - DNA, 26 bp, Artificial sequence
  SiRNA target sequence
aaacaaagaggataatatatttgata

SEQ ID NO: 237615 - DNA, 26 bp, Artificial sequence
  SiRNA target sequence
aacaaagaggataatatatttgatat

SEQ ID NO: 237616 - DNA, 26 bp, Artificial sequence
  SiRNA target sequence
acaaagaggataatatatttgatatt

SEQ ID NO: 237617 - DNA, 26 bp, Artificial sequence
  SiRNA target sequence
caaagaggataatatatttgatattt

SEQ ID NO: 237618 - DNA, 26 bp, Artificial sequence
  SiRNA target sequence
aaagaggataatatatttgatattta

SEQ ID NO: 237619 - DNA, 26 bp, Artificial sequence
  SiRNA target sequence
aagaggataatatatttgatatttac

SEQ ID NO: 237620 - DNA, 26 bp, Artificial sequence
  SiRNA target sequence
agaggataatatatttgatatttacc

SEQ ID NO: 237621 - DNA, 26 bp, Artificial sequence
  SiRNA target sequence
gaggataatatatttgatatttaccg

SEQ ID NO: 237622 - DNA, 26 bp, Artificial sequence
  SiRNA target sequence
aggataatatatttgatatttaccgt

SEQ ID NO: 237623 - DNA, 26 bp, Artificial sequence
  SiRNA target sequence
ggataatatatttgatatttaccgtt

SEQ ID NO: 237624 - DNA, 26 bp, Artificial sequence
  SiRNA target sequence
gataatatatttgatatttaccgttt

SEQ ID NO: 237625 - DNA, 26 bp, Artificial sequence
  SiRNA target sequence
ataatatatttgatatttaccgttta

SEQ ID NO: 237626 - DNA, 26 bp, Artificial sequence
  SiRNA target sequence
taatatatttgatatttaccgtttac

SEQ ID NO: 237627 - DNA, 26 bp, Artificial sequence
  SiRNA target sequence
aatatatttgatatttaccgtttacc

SEQ ID NO: 237628 - DNA, 26 bp, Artificial sequence
  SiRNA target sequence
atatatttgatatttaccgtttaccg

SEQ ID NO: 237629 - DNA, 26 bp, Artificial sequence
  SiRNA target sequence
tatatttgatatttaccgtttaccgt

SEQ ID NO: 237630 - DNA, 26 bp, Artificial sequence
  SiRNA target sequence
atatttgatatttaccgtttaccgtc

SEQ ID NO: 237631 - DNA, 26 bp, Artificial sequence
  SiRNA target sequence
tatttgatatttaccgtttaccgtca

SEQ ID NO: 237632 - DNA, 26 bp, Artificial sequence
  SiRNA target sequence
atttgatatttaccgtttaccgtcaa

SEQ ID NO: 237633 - DNA, 26 bp, Artificial sequence
  SiRNA target sequence
tttgatatttaccgtttaccgtcaac

SEQ ID NO: 237634 - DNA, 26 bp, Artificial sequence
  SiRNA target sequence
ttgatatttaccgtttaccgtcaact

SEQ ID NO: 237635 - DNA, 26 bp, Artificial sequence
  SiRNA target sequence
tgatatttaccgtttaccgtcaactg

SEQ ID NO: 237636 - DNA, 26 bp, Artificial sequence
  SiRNA target sequence
gatatttaccgtttaccgtcaactga

SEQ ID NO: 237637 - DNA, 26 bp, Artificial sequence
  SiRNA target sequence
atatttaccgtttaccgtcaactgat

SEQ ID NO: 237638 - DNA, 26 bp, Artificial sequence
  SiRNA target sequence
tatttaccgtttaccgtcaactgatt

SEQ ID NO: 237639 - DNA, 26 bp, Artificial sequence
  SiRNA target sequence
atttaccgtttaccgtcaactgattc

SEQ ID NO: 237640 - DNA, 26 bp, Artificial sequence
  SiRNA target sequence
tttaccgtttaccgtcaactgattct

SEQ ID NO: 237641 - DNA, 26 bp, Artificial sequence
  SiRNA target sequence
ttaccgtttaccgtcaactgattcta

SEQ ID NO: 237642 - DNA, 26 bp, Artificial sequence
  SiRNA target sequence
taccgtttaccgtcaactgattctat

SEQ ID NO: 237643 - DNA, 26 bp, Artificial sequence
  SiRNA target sequence
accgtttaccgtcaactgattctata

SEQ ID NO: 237644 - DNA, 26 bp, Artificial sequence
  SiRNA target sequence
ccgtttaccgtcaactgattctataa

SEQ ID NO: 237645 - DNA, 26 bp, Artificial sequence
  SiRNA target sequence
cgtttaccgtcaactgattctataat

SEQ ID NO: 237646 - DNA, 26 bp, Artificial sequence
  SiRNA target sequence
gtttaccgtcaactgattctataatc

SEQ ID NO: 237647 - DNA, 26 bp, Artificial sequence
  SiRNA target sequence
tttaccgtcaactgattctataatca

SEQ ID NO: 237648 - DNA, 26 bp, Artificial sequence
  SiRNA target sequence
ttaccgtcaactgattctataatcaa

SEQ ID NO: 237649 - DNA, 26 bp, Artificial sequence
  SiRNA target sequence
taccgtcaactgattctataatcaaa

SEQ ID NO: 237650 - DNA, 26 bp, Artificial sequence
  SiRNA target sequence
accgtcaactgattctataatcaaat

SEQ ID NO: 237651 - DNA, 26 bp, Artificial sequence
  SiRNA target sequence
ccgtcaactgattctataatcaaatt

SEQ ID NO: 237652 - DNA, 26 bp, Artificial sequence
  SiRNA target sequence
cgtcaactgattctataatcaaatta

SEQ ID NO: 237653 - DNA, 26 bp, Artificial sequence
  SiRNA target sequence
gtcaactgattctataatcaaattag

SEQ ID NO: 237654 - DNA, 26 bp, Artificial sequence
  SiRNA target sequence
tcaactgattctataatcaaattaga

SEQ ID NO: 237655 - DNA, 26 bp, Artificial sequence
  SiRNA target sequence
caactgattctataatcaaattagaa

SEQ ID NO: 237656 - DNA, 26 bp, Artificial sequence
  SiRNA target sequence
aactgattctataatcaaattagaaa

SEQ ID NO: 237657 - DNA, 26 bp, Artificial sequence
  SiRNA target sequence
actgattctataatcaaattagaaaa

SEQ ID NO: 237658 - DNA, 26 bp, Artificial sequence
  SiRNA target sequence
ctgattctataatcaaattagaaaat

SEQ ID NO: 237659 - DNA, 26 bp, Artificial sequence
  SiRNA target sequence
tgattctataatcaaattagaaaata

SEQ ID NO: 237660 - DNA, 26 bp, Artificial sequence
  SiRNA target sequence
gattctataatcaaattagaaaatat

SEQ ID NO: 237661 - DNA, 26 bp, Artificial sequence
  SiRNA target sequence
attctataatcaaattagaaaatatt

SEQ ID NO: 237662 - DNA, 26 bp, Artificial sequence
  SiRNA target sequence
ttctataatcaaattagaaaatattg

SEQ ID NO: 237663 - DNA, 26 bp, Artificial sequence
  SiRNA target sequence
tctataatcaaattagaaaatattgt

SEQ ID NO: 237664 - DNA, 26 bp, Artificial sequence
  SiRNA target sequence
ctataatcaaattagaaaatattgtt

SEQ ID NO: 237665 - DNA, 26 bp, Artificial sequence
  SiRNA target sequence
tataatcaaattagaaaatattgttg

SEQ ID NO: 237666 - DNA, 26 bp, Artificial sequence
  SiRNA target sequence
ataatcaaattagaaaatattgttgg

SEQ ID NO: 237667 - DNA, 26 bp, Artificial sequence
  SiRNA target sequence
taatcaaattagaaaatattgttggt

SEQ ID NO: 237668 - DNA, 26 bp, Artificial sequence
  SiRNA target sequence
aatcaaattagaaaatattgttggtg

SEQ ID NO: 237669 - DNA, 26 bp, Artificial sequence
  SiRNA target sequence
atcaaattagaaaatattgttggtgt

SEQ ID NO: 237670 - DNA, 26 bp, Artificial sequence
  SiRNA target sequence
tcaaattagaaaatattgttggtgtc

SEQ ID NO: 237671 - DNA, 26 bp, Artificial sequence
  SiRNA target sequence
caaattagaaaatattgttggtgtca

SEQ ID NO: 237672 - DNA, 26 bp, Artificial sequence
  SiRNA target sequence
aaattagaaaatattgttggtgtcat

SEQ ID NO: 237673 - DNA, 26 bp, Artificial sequence
  SiRNA target sequence
aattagaaaatattgttggtgtcatt

SEQ ID NO: 237674 - DNA, 26 bp, Artificial sequence
  SiRNA target sequence
attagaaaatattgttggtgtcattt

SEQ ID NO: 237675 - DNA, 26 bp, Artificial sequence
  SiRNA target sequence
ttagaaaatattgttggtgtcatttg

SEQ ID NO: 237676 - DNA, 26 bp, Artificial sequence
  SiRNA target sequence
tagaaaatattgttggtgtcatttgt

SEQ ID NO: 237677 - DNA, 26 bp, Artificial sequence
  SiRNA target sequence
agaaaatattgttggtgtcatttgtg

SEQ ID NO: 237678 - DNA, 26 bp, Artificial sequence
  SiRNA target sequence
gaaaatattgttggtgtcatttgtgt

SEQ ID NO: 237679 - DNA, 26 bp, Artificial sequence
  SiRNA target sequence
aaaatattgttggtgtcatttgtgta

SEQ ID NO: 237680 - DNA, 26 bp, Artificial sequence
  SiRNA target sequence
aaatattgttggtgtcatttgtgtat

SEQ ID NO: 237681 - DNA, 26 bp, Artificial sequence
  SiRNA target sequence
aatattgttggtgtcatttgtgtatc

SEQ ID NO: 237682 - DNA, 26 bp, Artificial sequence
  SiRNA target sequence
atattgttggtgtcatttgtgtatct

SEQ ID NO: 237683 - DNA, 26 bp, Artificial sequence
  SiRNA target sequence
tattgttggtgtcatttgtgtatctt

SEQ ID NO: 237684 - DNA, 26 bp, Artificial sequence
  SiRNA target sequence
attgttggtgtcatttgtgtatcttt

SEQ ID NO: 237685 - DNA, 26 bp, Artificial sequence
  SiRNA target sequence
ttgttggtgtcatttgtgtatcttta

SEQ ID NO: 237686 - DNA, 26 bp, Artificial sequence
  SiRNA target sequence
tgttggtgtcatttgtgtatctttaa

SEQ ID NO: 237687 - DNA, 26 bp, Artificial sequence
  SiRNA target sequence
gttggtgtcatttgtgtatctttaat

SEQ ID NO: 237688 - DNA, 26 bp, Artificial sequence
  SiRNA target sequence
ttggtgtcatttgtgtatctttaatg

SEQ ID NO: 237689 - DNA, 26 bp, Artificial sequence
  SiRNA target sequence
tggtgtcatttgtgtatctttaatga

SEQ ID NO: 237690 - DNA, 26 bp, Artificial sequence
  SiRNA target sequence
ggtgtcatttgtgtatctttaatgaa

SEQ ID NO: 237691 - DNA, 26 bp, Artificial sequence
  SiRNA target sequence
gtgtcatttgtgtatctttaatgaag

SEQ ID NO: 237692 - DNA, 26 bp, Artificial sequence
  SiRNA target sequence
tgtcatttgtgtatctttaatgaaga

SEQ ID NO: 237693 - DNA, 26 bp, Artificial sequence
  SiRNA target sequence
gtcatttgtgtatctttaatgaagat

SEQ ID NO: 237694 - DNA, 26 bp, Artificial sequence
  SiRNA target sequence
tcatttgtgtatctttaatgaagatt

SEQ ID NO: 237695 - DNA, 26 bp, Artificial sequence
  SiRNA target sequence
catttgtgtatctttaatgaagattt

SEQ ID NO: 237696 - DNA, 26 bp, Artificial sequence
  SiRNA target sequence
atttgtgtatctttaatgaagatttc

SEQ ID NO: 237697 - DNA, 26 bp, Artificial sequence
  SiRNA target sequence
tttgtgtatctttaatgaagatttct

SEQ ID NO: 237698 - DNA, 26 bp, Artificial sequence
  SiRNA target sequence
ttgtgtatctttaatgaagatttcta

SEQ ID NO: 237699 - DNA, 26 bp, Artificial sequence
  SiRNA target sequence
tgtgtatctttaatgaagatttctaa

SEQ ID NO: 237700 - DNA, 26 bp, Artificial sequence
  SiRNA target sequence
gtgtatctttaatgaagatttctaaa

SEQ ID NO: 237701 - DNA, 26 bp, Artificial sequence
  SiRNA target sequence
tgtatctttaatgaagatttctaaat

SEQ ID NO: 237702 - DNA, 26 bp, Artificial sequence
  SiRNA target sequence
gtatctttaatgaagatttctaaata

SEQ ID NO: 237703 - DNA, 26 bp, Artificial sequence
  SiRNA target sequence
tatctttaatgaagatttctaaatat

SEQ ID NO: 237704 - DNA, 26 bp, Artificial sequence
  SiRNA target sequence
atctttaatgaagatttctaaatatg

SEQ ID NO: 237705 - DNA, 26 bp, Artificial sequence
  SiRNA target sequence
tctttaatgaagatttctaaatatgc

SEQ ID NO: 237706 - DNA, 26 bp, Artificial sequence
  SiRNA target sequence
ctttaatgaagatttctaaatatgca

SEQ ID NO: 237707 - DNA, 26 bp, Artificial sequence
  SiRNA target sequence
tttaatgaagatttctaaatatgcag

SEQ ID NO: 237708 - DNA, 26 bp, Artificial sequence
  SiRNA target sequence
ttaatgaagatttctaaatatgcagc

SEQ ID NO: 237709 - DNA, 26 bp, Artificial sequence
  SiRNA target sequence
taatgaagatttctaaatatgcagca

SEQ ID NO: 237710 - DNA, 26 bp, Artificial sequence
  SiRNA target sequence
aatgaagatttctaaatatgcagcat

SEQ ID NO: 237711 - DNA, 26 bp, Artificial sequence
  SiRNA target sequence
atgaagatttctaaatatgcagcatt

SEQ ID NO: 237712 - DNA, 26 bp, Artificial sequence
  SiRNA target sequence
tgaagatttctaaatatgcagcattt

SEQ ID NO: 237713 - DNA, 26 bp, Artificial sequence
  SiRNA target sequence
gaagatttctaaatatgcagcatttg

SEQ ID NO: 237714 - DNA, 26 bp, Artificial sequence
  SiRNA target sequence
aagatttctaaatatgcagcatttga

SEQ ID NO: 237715 - DNA, 26 bp, Artificial sequence
  SiRNA target sequence
agatttctaaatatgcagcatttgat

SEQ ID NO: 237716 - DNA, 26 bp, Artificial sequence
  SiRNA target sequence
gatttctaaatatgcagcatttgata

SEQ ID NO: 237717 - DNA, 26 bp, Artificial sequence
  SiRNA target sequence
atttctaaatatgcagcatttgatat

SEQ ID NO: 237718 - DNA, 26 bp, Artificial sequence
  SiRNA target sequence
tttctaaatatgcagcatttgatatc

SEQ ID NO: 237719 - DNA, 26 bp, Artificial sequence
  SiRNA target sequence
ttctaaatatgcagcatttgatatca

SEQ ID NO: 237720 - DNA, 26 bp, Artificial sequence
  SiRNA target sequence
tctaaatatgcagcatttgatatcac

SEQ ID NO: 237721 - DNA, 26 bp, Artificial sequence
  SiRNA target sequence
ctaaatatgcagcatttgatatcaca

SEQ ID NO: 237722 - DNA, 26 bp, Artificial sequence
  SiRNA target sequence
taaatatgcagcatttgatatcacaa

SEQ ID NO: 237723 - DNA, 26 bp, Artificial sequence
  SiRNA target sequence
aaatatgcagcatttgatatcacaaa

SEQ ID NO: 237724 - DNA, 26 bp, Artificial sequence
  SiRNA target sequence
aatatgcagcatttgatatcacaaaa

SEQ ID NO: 237725 - DNA, 26 bp, Artificial sequence
  SiRNA target sequence
atatgcagcatttgatatcacaaaag

SEQ ID NO: 237726 - DNA, 26 bp, Artificial sequence
  SiRNA target sequence
tatgcagcatttgatatcacaaaaga

SEQ ID NO: 237727 - DNA, 26 bp, Artificial sequence
  SiRNA target sequence
atgcagcatttgatatcacaaaagag

SEQ ID NO: 237728 - DNA, 26 bp, Artificial sequence
  SiRNA target sequence
tgcagcatttgatatcacaaaagagg

SEQ ID NO: 237729 - DNA, 26 bp, Artificial sequence
  SiRNA target sequence
gcagcatttgatatcacaaaagaggc

SEQ ID NO: 237730 - DNA, 26 bp, Artificial sequence
  SiRNA target sequence
cagcatttgatatcacaaaagaggct

SEQ ID NO: 237731 - DNA, 26 bp, Artificial sequence
  SiRNA target sequence
agcatttgatatcacaaaagaggctt

SEQ ID NO: 237732 - DNA, 26 bp, Artificial sequence
  SiRNA target sequence
gcatttgatatcacaaaagaggcttt

SEQ ID NO: 237733 - DNA, 26 bp, Artificial sequence
  SiRNA target sequence
catttgatatcacaaaagaggctttg

SEQ ID NO: 237734 - DNA, 26 bp, Artificial sequence
  SiRNA target sequence
atttgatatcacaaaagaggctttgt

SEQ ID NO: 237735 - DNA, 26 bp, Artificial sequence
  SiRNA target sequence
tttgatatcacaaaagaggctttgtc

SEQ ID NO: 237736 - DNA, 26 bp, Artificial sequence
  SiRNA target sequence
ttgatatcacaaaagaggctttgtct

SEQ ID NO: 237737 - DNA, 26 bp, Artificial sequence
  SiRNA target sequence
tgatatcacaaaagaggctttgtcta

SEQ ID NO: 237738 - DNA, 26 bp, Artificial sequence
  SiRNA target sequence
gatatcacaaaagaggctttgtctat

SEQ ID NO: 237739 - DNA, 26 bp, Artificial sequence
  SiRNA target sequence
atatcacaaaagaggctttgtctatg

SEQ ID NO: 237740 - DNA, 26 bp, Artificial sequence
  SiRNA target sequence
tatcacaaaagaggctttgtctatgc

SEQ ID NO: 237741 - DNA, 26 bp, Artificial sequence
  SiRNA target sequence
atcacaaaagaggctttgtctatgca

SEQ ID NO: 237742 - DNA, 26 bp, Artificial sequence
  SiRNA target sequence
tcacaaaagaggctttgtctatgcag

SEQ ID NO: 237743 - DNA, 26 bp, Artificial sequence
  SiRNA target sequence
cacaaaagaggctttgtctatgcaga

SEQ ID NO: 237744 - DNA, 26 bp, Artificial sequence
  SiRNA target sequence
acaaaagaggctttgtctatgcagat

SEQ ID NO: 237745 - DNA, 26 bp, Artificial sequence
  SiRNA target sequence
caaaagaggctttgtctatgcagatt

SEQ ID NO: 237746 - DNA, 26 bp, Artificial sequence
  SiRNA target sequence
aaaagaggctttgtctatgcagattg

SEQ ID NO: 237747 - DNA, 26 bp, Artificial sequence
  SiRNA target sequence
aaagaggctttgtctatgcagattga

SEQ ID NO: 237748 - DNA, 26 bp, Artificial sequence
  SiRNA target sequence
aagaggctttgtctatgcagattgat

SEQ ID NO: 237749 - DNA, 26 bp, Artificial sequence
  SiRNA target sequence
agaggctttgtctatgcagattgatg

SEQ ID NO: 237750 - DNA, 26 bp, Artificial sequence
  SiRNA target sequence
gaggctttgtctatgcagattgatgg

SEQ ID NO: 237751 - DNA, 26 bp, Artificial sequence
  SiRNA target sequence
aggctttgtctatgcagattgatggt

SEQ ID NO: 237752 - DNA, 26 bp, Artificial sequence
  SiRNA target sequence
ggctttgtctatgcagattgatggtt

SEQ ID NO: 237753 - DNA, 26 bp, Artificial sequence
  SiRNA target sequence
gctttgtctatgcagattgatggttc

SEQ ID NO: 237754 - DNA, 26 bp, Artificial sequence
  SiRNA target sequence
ctttgtctatgcagattgatggttct

SEQ ID NO: 237755 - DNA, 26 bp, Artificial sequence
  SiRNA target sequence
tttgtctatgcagattgatggttcta

SEQ ID NO: 237756 - DNA, 26 bp, Artificial sequence
  SiRNA target sequence
ttgtctatgcagattgatggttctat

SEQ ID NO: 237757 - DNA, 26 bp, Artificial sequence
  SiRNA target sequence
tgtctatgcagattgatggttctata

SEQ ID NO: 237758 - DNA, 26 bp, Artificial sequence
  SiRNA target sequence
gtctatgcagattgatggttctataa

SEQ ID NO: 237759 - DNA, 26 bp, Artificial sequence
  SiRNA target sequence
tctatgcagattgatggttctataag

SEQ ID NO: 237760 - DNA, 26 bp, Artificial sequence
  SiRNA target sequence
ctatgcagattgatggttctataaga

SEQ ID NO: 237761 - DNA, 26 bp, Artificial sequence
  SiRNA target sequence
tatgcagattgatggttctataagag

SEQ ID NO: 237762 - DNA, 26 bp, Artificial sequence
  SiRNA target sequence
atgcagattgatggttctataagagc

SEQ ID NO: 237763 - DNA, 26 bp, Artificial sequence
  SiRNA target sequence
tgcagattgatggttctataagagcg

SEQ ID NO: 237764 - DNA, 26 bp, Artificial sequence
  SiRNA target sequence
gcagattgatggttctataagagcga

SEQ ID NO: 237765 - DNA, 26 bp, Artificial sequence
  SiRNA target sequence
cagattgatggttctataagagcgaa

SEQ ID NO: 237766 - DNA, 26 bp, Artificial sequence
  SiRNA target sequence
agattgatggttctataagagcgaaa

SEQ ID NO: 237767 - DNA, 26 bp, Artificial sequence
  SiRNA target sequence
gattgatggttctataagagcgaaat

SEQ ID NO: 237768 - DNA, 26 bp, Artificial sequence
  SiRNA target sequence
attgatggttctataagagcgaaata

SEQ ID NO: 237769 - DNA, 26 bp, Artificial sequence
  SiRNA target sequence
ttgatggttctataagagcgaaatac

SEQ ID NO: 237770 - DNA, 26 bp, Artificial sequence
  SiRNA target sequence
tgatggttctataagagcgaaataca

SEQ ID NO: 237771 - DNA, 26 bp, Artificial sequence
  SiRNA target sequence
gatggttctataagagcgaaatacaa

SEQ ID NO: 237772 - DNA, 26 bp, Artificial sequence
  SiRNA target sequence
atggttctataagagcgaaatacaaa

SEQ ID NO: 237773 - DNA, 26 bp, Artificial sequence
  SiRNA target sequence
tggttctataagagcgaaatacaaag

SEQ ID NO: 237774 - DNA, 26 bp, Artificial sequence
  SiRNA target sequence
ggttctataagagcgaaatacaaagg

SEQ ID NO: 237775 - DNA, 26 bp, Artificial sequence
  SiRNA target sequence
gttctataagagcgaaatacaaaggt

SEQ ID NO: 237776 - DNA, 26 bp, Artificial sequence
  SiRNA target sequence
ttctataagagcgaaatacaaaggta

SEQ ID NO: 237777 - DNA, 26 bp, Artificial sequence
  SiRNA target sequence
tctataagagcgaaatacaaaggtat

SEQ ID NO: 237778 - DNA, 26 bp, Artificial sequence
  SiRNA target sequence
ctataagagcgaaatacaaaggtatt

SEQ ID NO: 237779 - DNA, 26 bp, Artificial sequence
  SiRNA target sequence
tataagagcgaaatacaaaggtattt

SEQ ID NO: 237780 - DNA, 26 bp, Artificial sequence
  SiRNA target sequence
ataagagcgaaatacaaaggtatttt

SEQ ID NO: 237781 - DNA, 26 bp, Artificial sequence
  SiRNA target sequence
taagagcgaaatacaaaggtattttt

SEQ ID NO: 237782 - DNA, 26 bp, Artificial sequence
  SiRNA target sequence
aagagcgaaatacaaaggtatttttg

SEQ ID NO: 237783 - DNA, 26 bp, Artificial sequence
  SiRNA target sequence
agagcgaaatacaaaggtatttttga

SEQ ID NO: 237784 - DNA, 26 bp, Artificial sequence
  SiRNA target sequence
gagcgaaatacaaaggtatttttgat

SEQ ID NO: 237785 - DNA, 26 bp, Artificial sequence
  SiRNA target sequence
agcgaaatacaaaggtatttttgatg

SEQ ID NO: 237786 - DNA, 26 bp, Artificial sequence
  SiRNA target sequence
gcgaaatacaaaggtatttttgatgg

SEQ ID NO: 237787 - DNA, 26 bp, Artificial sequence
  SiRNA target sequence
cgaaatacaaaggtatttttgatggt

SEQ ID NO: 237788 - DNA, 26 bp, Artificial sequence
  SiRNA target sequence
gaaatacaaaggtatttttgatggtg

SEQ ID NO: 237789 - DNA, 26 bp, Artificial sequence
  SiRNA target sequence
aaatacaaaggtatttttgatggtgt

SEQ ID NO: 237790 - DNA, 26 bp, Artificial sequence
  SiRNA target sequence
aatacaaaggtatttttgatggtgta

SEQ ID NO: 237791 - DNA, 26 bp, Artificial sequence
  SiRNA target sequence
atacaaaggtatttttgatggtgtat

SEQ ID NO: 237792 - DNA, 26 bp, Artificial sequence
  SiRNA target sequence
tacaaaggtatttttgatggtgtatt

SEQ ID NO: 237793 - DNA, 26 bp, Artificial sequence
  SiRNA target sequence
acaaaggtatttttgatggtgtattt

SEQ ID NO: 237794 - DNA, 26 bp, Artificial sequence
  SiRNA target sequence
caaaggtatttttgatggtgtatttg

SEQ ID NO: 237795 - DNA, 26 bp, Artificial sequence
  SiRNA target sequence
aaaggtatttttgatggtgtatttgg

SEQ ID NO: 237796 - DNA, 26 bp, Artificial sequence
  SiRNA target sequence
aaggtatttttgatggtgtatttggt

SEQ ID NO: 237797 - DNA, 26 bp, Artificial sequence
  SiRNA target sequence
aggtatttttgatggtgtatttggta

SEQ ID NO: 237798 - DNA, 26 bp, Artificial sequence
  SiRNA target sequence
ggtatttttgatggtgtatttggtaa

SEQ ID NO: 237799 - DNA, 26 bp, Artificial sequence
  SiRNA target sequence
gtatttttgatggtgtatttggtaag

SEQ ID NO: 237800 - DNA, 26 bp, Artificial sequence
  SiRNA target sequence
tatttttgatggtgtatttggtaagc

SEQ ID NO: 237801 - DNA, 26 bp, Artificial sequence
  SiRNA target sequence
atttttgatggtgtatttggtaagct

SEQ ID NO: 237802 - DNA, 26 bp, Artificial sequence
  SiRNA target sequence
tttttgatggtgtatttggtaagctg

SEQ ID NO: 237803 - DNA, 26 bp, Artificial sequence
  SiRNA target sequence
ttttgatggtgtatttggtaagctgg

SEQ ID NO: 237804 - DNA, 26 bp, Artificial sequence
  SiRNA target sequence
tttgatggtgtatttggtaagctggg

SEQ ID NO: 237805 - DNA, 26 bp, Artificial sequence
  SiRNA target sequence
ttgatggtgtatttggtaagctgggg

SEQ ID NO: 237806 - DNA, 26 bp, Artificial sequence
  SiRNA target sequence
tgatggtgtatttggtaagctgggga

SEQ ID NO: 237807 - DNA, 26 bp, Artificial sequence
  SiRNA target sequence
gatggtgtatttggtaagctggggaa

SEQ ID NO: 237808 - DNA, 26 bp, Artificial sequence
  SiRNA target sequence
atggtgtatttggtaagctggggaaa

SEQ ID NO: 237809 - DNA, 26 bp, Artificial sequence
  SiRNA target sequence
tggtgtatttggtaagctggggaaat

SEQ ID NO: 237810 - DNA, 26 bp, Artificial sequence
  SiRNA target sequence
ggtgtatttggtaagctggggaaatc

SEQ ID NO: 237811 - DNA, 26 bp, Artificial sequence
  SiRNA target sequence
gtgtatttggtaagctggggaaatct

SEQ ID NO: 237812 - DNA, 26 bp, Artificial sequence
  SiRNA target sequence
tgtatttggtaagctggggaaatctt

SEQ ID NO: 237813 - DNA, 26 bp, Artificial sequence
  SiRNA target sequence
gtatttggtaagctggggaaatcttt

SEQ ID NO: 237814 - DNA, 26 bp, Artificial sequence
  SiRNA target sequence
tatttggtaagctggggaaatctttt

SEQ ID NO: 237815 - DNA, 26 bp, Artificial sequence
  SiRNA target sequence
atttggtaagctggggaaatcttttg

SEQ ID NO: 237816 - DNA, 26 bp, Artificial sequence
  SiRNA target sequence
tttggtaagctggggaaatcttttgg

SEQ ID NO: 237817 - DNA, 26 bp, Artificial sequence
  SiRNA target sequence
ttggtaagctggggaaatcttttgga

SEQ ID NO: 237818 - DNA, 26 bp, Artificial sequence
  SiRNA target sequence
tggtaagctggggaaatcttttggat

SEQ ID NO: 237819 - DNA, 26 bp, Artificial sequence
  SiRNA target sequence
ggtaagctggggaaatcttttggatc

SEQ ID NO: 237820 - DNA, 26 bp, Artificial sequence
  SiRNA target sequence
gtaagctggggaaatcttttggatca

SEQ ID NO: 237821 - DNA, 26 bp, Artificial sequence
  SiRNA target sequence
taagctggggaaatcttttggatcag

SEQ ID NO: 237822 - DNA, 26 bp, Artificial sequence
  SiRNA target sequence
aagctggggaaatcttttggatcagt

SEQ ID NO: 237823 - DNA, 26 bp, Artificial sequence
  SiRNA target sequence
agctggggaaatcttttggatcagtt

SEQ ID NO: 237824 - DNA, 26 bp, Artificial sequence
  SiRNA target sequence
gctggggaaatcttttggatcagttt

SEQ ID NO: 237825 - DNA, 26 bp, Artificial sequence
  SiRNA target sequence
ctggggaaatcttttggatcagttta

SEQ ID NO: 237826 - DNA, 26 bp, Artificial sequence
  SiRNA target sequence
tggggaaatcttttggatcagtttat

SEQ ID NO: 237827 - DNA, 26 bp, Artificial sequence
  SiRNA target sequence
ggggaaatcttttggatcagtttatg

SEQ ID NO: 237828 - DNA, 26 bp, Artificial sequence
  SiRNA target sequence
gggaaatcttttggatcagtttatgg

SEQ ID NO: 237829 - DNA, 26 bp, Artificial sequence
  SiRNA target sequence
ggaaatcttttggatcagtttatgga

SEQ ID NO: 237830 - DNA, 26 bp, Artificial sequence
  SiRNA target sequence
gaaatcttttggatcagtttatggat

SEQ ID NO: 237831 - DNA, 26 bp, Artificial sequence
  SiRNA target sequence
aaatcttttggatcagtttatggatt

SEQ ID NO: 237832 - DNA, 26 bp, Artificial sequence
  SiRNA target sequence
aatcttttggatcagtttatggattt

SEQ ID NO: 237833 - DNA, 26 bp, Artificial sequence
  SiRNA target sequence
atcttttggatcagtttatggattta

SEQ ID NO: 237834 - DNA, 26 bp, Artificial sequence
  SiRNA target sequence
tcttttggatcagtttatggatttac

SEQ ID NO: 237835 - DNA, 26 bp, Artificial sequence
  SiRNA target sequence
cttttggatcagtttatggatttaca

SEQ ID NO: 237836 - DNA, 26 bp, Artificial sequence
  SiRNA target sequence
ttttggatcagtttatggatttacaa

SEQ ID NO: 237837 - DNA, 26 bp, Artificial sequence
  SiRNA target sequence
tttggatcagtttatggatttacaat

SEQ ID NO: 237838 - DNA, 26 bp, Artificial sequence
  SiRNA target sequence
ttggatcagtttatggatttacaatt

SEQ ID NO: 237839 - DNA, 26 bp, Artificial sequence
  SiRNA target sequence
tggatcagtttatggatttacaatta

SEQ ID NO: 237840 - DNA, 26 bp, Artificial sequence
  SiRNA target sequence
ggatcagtttatggatttacaattac

SEQ ID NO: 237841 - DNA, 26 bp, Artificial sequence
  SiRNA target sequence
gatcagtttatggatttacaattact

SEQ ID NO: 237842 - DNA, 26 bp, Artificial sequence
  SiRNA target sequence
atcagtttatggatttacaattacta

SEQ ID NO: 237843 - DNA, 26 bp, Artificial sequence
  SiRNA target sequence
tcagtttatggatttacaattactac

SEQ ID NO: 237844 - DNA, 26 bp, Artificial sequence
  SiRNA target sequence
cagtttatggatttacaattactaca

SEQ ID NO: 237845 - DNA, 26 bp, Artificial sequence
  SiRNA target sequence
agtttatggatttacaattactacat

SEQ ID NO: 237846 - DNA, 26 bp, Artificial sequence
  SiRNA target sequence
gtttatggatttacaattactacatt

SEQ ID NO: 237847 - DNA, 26 bp, Artificial sequence
  SiRNA target sequence
tttatggatttacaattactacatta

SEQ ID NO: 237848 - DNA, 26 bp, Artificial sequence
  SiRNA target sequence
ttatggatttacaattactacattat

SEQ ID NO: 237849 - DNA, 26 bp, Artificial sequence
  SiRNA target sequence
tatggatttacaattactacattatt

SEQ ID NO: 237850 - DNA, 26 bp, Artificial sequence
  SiRNA target sequence
atggatttacaattactacattatta

SEQ ID NO: 237851 - DNA, 26 bp, Artificial sequence
  SiRNA target sequence
tggatttacaattactacattattag

SEQ ID NO: 237852 - DNA, 26 bp, Artificial sequence
  SiRNA target sequence
ggatttacaattactacattattagg

SEQ ID NO: 237853 - DNA, 26 bp, Artificial sequence
  SiRNA target sequence
gatttacaattactacattattagga

SEQ ID NO: 237854 - DNA, 26 bp, Artificial sequence
  SiRNA target sequence
atttacaattactacattattaggaa

SEQ ID NO: 237855 - DNA, 26 bp, Artificial sequence
  SiRNA target sequence
tttacaattactacattattaggaac

SEQ ID NO: 237856 - DNA, 26 bp, Artificial sequence
  SiRNA target sequence
ttacaattactacattattaggaaca

SEQ ID NO: 237857 - DNA, 26 bp, Artificial sequence
  SiRNA target sequence
tacaattactacattattaggaacaa

SEQ ID NO: 237858 - DNA, 26 bp, Artificial sequence
  SiRNA target sequence
acaattactacattattaggaacaag

SEQ ID NO: 237859 - DNA, 26 bp, Artificial sequence
  SiRNA target sequence
caattactacattattaggaacaaga

SEQ ID NO: 237860 - DNA, 26 bp, Artificial sequence
  SiRNA target sequence
aattactacattattaggaacaagag

SEQ ID NO: 237861 - DNA, 26 bp, Artificial sequence
  SiRNA target sequence
attactacattattaggaacaagaga

SEQ ID NO: 237862 - DNA, 26 bp, Artificial sequence
  SiRNA target sequence
ttactacattattaggaacaagagat

SEQ ID NO: 237863 - DNA, 26 bp, Artificial sequence
  SiRNA target sequence
tactacattattaggaacaagagatg

SEQ ID NO: 237864 - DNA, 26 bp, Artificial sequence
  SiRNA target sequence
actacattattaggaacaagagatgt

SEQ ID NO: 237865 - DNA, 26 bp, Artificial sequence
  SiRNA target sequence
ctacattattaggaacaagagatgtt

SEQ ID NO: 237866 - DNA, 26 bp, Artificial sequence
  SiRNA target sequence
tacattattaggaacaagagatgttc

SEQ ID NO: 237867 - DNA, 26 bp, Artificial sequence
  SiRNA target sequence
acattattaggaacaagagatgttcg

SEQ ID NO: 237868 - DNA, 26 bp, Artificial sequence
  SiRNA target sequence
cattattaggaacaagagatgttcgt

SEQ ID NO: 237869 - DNA, 26 bp, Artificial sequence
  SiRNA target sequence
attattaggaacaagagatgttcgta

SEQ ID NO: 237870 - DNA, 26 bp, Artificial sequence
  SiRNA target sequence
ttattaggaacaagagatgttcgtag

SEQ ID NO: 237871 - DNA, 26 bp, Artificial sequence
  SiRNA target sequence
tattaggaacaagagatgttcgtaga

SEQ ID NO: 237872 - DNA, 26 bp, Artificial sequence
  SiRNA target sequence
attaggaacaagagatgttcgtagag

SEQ ID NO: 237873 - DNA, 26 bp, Artificial sequence
  SiRNA target sequence
ttaggaacaagagatgttcgtagagg

SEQ ID NO: 237874 - DNA, 26 bp, Artificial sequence
  SiRNA target sequence
taggaacaagagatgttcgtagaggt

SEQ ID NO: 237875 - DNA, 26 bp, Artificial sequence
  SiRNA target sequence
aggaacaagagatgttcgtagaggtg

SEQ ID NO: 237876 - DNA, 26 bp, Artificial sequence
  SiRNA target sequence
ggaacaagagatgttcgtagaggtgc

SEQ ID NO: 237877 - DNA, 26 bp, Artificial sequence
  SiRNA target sequence
gaacaagagatgttcgtagaggtgct

SEQ ID NO: 237878 - DNA, 26 bp, Artificial sequence
  SiRNA target sequence
aacaagagatgttcgtagaggtgctc

SEQ ID NO: 237879 - DNA, 26 bp, Artificial sequence
  SiRNA target sequence
acaagagatgttcgtagaggtgctcc

SEQ ID NO: 237880 - DNA, 26 bp, Artificial sequence
  SiRNA target sequence
caagagatgttcgtagaggtgctcct

SEQ ID NO: 237881 - DNA, 26 bp, Artificial sequence
  SiRNA target sequence
aagagatgttcgtagaggtgctccta

SEQ ID NO: 237882 - DNA, 26 bp, Artificial sequence
  SiRNA target sequence
agagatgttcgtagaggtgctcctat

SEQ ID NO: 237883 - DNA, 26 bp, Artificial sequence
  SiRNA target sequence
gagatgttcgtagaggtgctcctata

SEQ ID NO: 237884 - DNA, 26 bp, Artificial sequence
  SiRNA target sequence
agatgttcgtagaggtgctcctatat

SEQ ID NO: 237885 - DNA, 26 bp, Artificial sequence
  SiRNA target sequence
gatgttcgtagaggtgctcctatatc

SEQ ID NO: 237886 - DNA, 26 bp, Artificial sequence
  SiRNA target sequence
atgttcgtagaggtgctcctatatcg

SEQ ID NO: 237887 - DNA, 26 bp, Artificial sequence
  SiRNA target sequence
tgttcgtagaggtgctcctatatcgc

SEQ ID NO: 237888 - DNA, 26 bp, Artificial sequence
  SiRNA target sequence
gttcgtagaggtgctcctatatcgct

SEQ ID NO: 237889 - DNA, 26 bp, Artificial sequence
  SiRNA target sequence
ttcgtagaggtgctcctatatcgctt

SEQ ID NO: 237890 - DNA, 26 bp, Artificial sequence
  SiRNA target sequence
tcgtagaggtgctcctatatcgcttt

SEQ ID NO: 237891 - DNA, 26 bp, Artificial sequence
  SiRNA target sequence
cgtagaggtgctcctatatcgctttg

SEQ ID NO: 237892 - DNA, 26 bp, Artificial sequence
  SiRNA target sequence
gtagaggtgctcctatatcgctttgt

SEQ ID NO: 237893 - DNA, 26 bp, Artificial sequence
  SiRNA target sequence
tagaggtgctcctatatcgctttgtg

SEQ ID NO: 237894 - DNA, 26 bp, Artificial sequence
  SiRNA target sequence
agaggtgctcctatatcgctttgtgt

SEQ ID NO: 237895 - DNA, 26 bp, Artificial sequence
  SiRNA target sequence
gaggtgctcctatatcgctttgtgtt

SEQ ID NO: 237896 - DNA, 26 bp, Artificial sequence
  SiRNA target sequence
aggtgctcctatatcgctttgtgttc

SEQ ID NO: 237897 - DNA, 26 bp, Artificial sequence
  SiRNA target sequence
ggtgctcctatatcgctttgtgttct

SEQ ID NO: 237898 - DNA, 26 bp, Artificial sequence
  SiRNA target sequence
gtgctcctatatcgctttgtgttcta

SEQ ID NO: 237899 - DNA, 26 bp, Artificial sequence
  SiRNA target sequence
tgctcctatatcgctttgtgttctaa

SEQ ID NO: 237900 - DNA, 26 bp, Artificial sequence
  SiRNA target sequence
gctcctatatcgctttgtgttctaat

SEQ ID NO: 237901 - DNA, 26 bp, Artificial sequence
  SiRNA target sequence
ctcctatatcgctttgtgttctaata

SEQ ID NO: 237902 - DNA, 26 bp, Artificial sequence
  SiRNA target sequence
tcctatatcgctttgtgttctaatat

SEQ ID NO: 237903 - DNA, 26 bp, Artificial sequence
  SiRNA target sequence
cctatatcgctttgtgttctaatatt

SEQ ID NO: 237904 - DNA, 26 bp, Artificial sequence
  SiRNA target sequence
ctatatcgctttgtgttctaatattg

SEQ ID NO: 237905 - DNA, 26 bp, Artificial sequence
  SiRNA target sequence
tatatcgctttgtgttctaatattgt

SEQ ID NO: 237906 - DNA, 26 bp, Artificial sequence
  SiRNA target sequence
atatcgctttgtgttctaatattgtt

SEQ ID NO: 237907 - DNA, 26 bp, Artificial sequence
  SiRNA target sequence
tatcgctttgtgttctaatattgttc

SEQ ID NO: 237908 - DNA, 26 bp, Artificial sequence
  SiRNA target sequence
atcgctttgtgttctaatattgttct

SEQ ID NO: 237909 - DNA, 26 bp, Artificial sequence
  SiRNA target sequence
tcgctttgtgttctaatattgttctg

SEQ ID NO: 237910 - DNA, 26 bp, Artificial sequence
  SiRNA target sequence
cgctttgtgttctaatattgttctgc

SEQ ID NO: 237911 - DNA, 26 bp, Artificial sequence
  SiRNA target sequence
gctttgtgttctaatattgttctgcc

SEQ ID NO: 237912 - DNA, 26 bp, Artificial sequence
  SiRNA target sequence
ctttgtgttctaatattgttctgcct

SEQ ID NO: 237913 - DNA, 26 bp, Artificial sequence
  SiRNA target sequence
tttgtgttctaatattgttctgcctt

SEQ ID NO: 237914 - DNA, 26 bp, Artificial sequence
  SiRNA target sequence
ttgtgttctaatattgttctgcctta

SEQ ID NO: 237915 - DNA, 26 bp, Artificial sequence
  SiRNA target sequence
tgtgttctaatattgttctgccttat

SEQ ID NO: 237916 - DNA, 26 bp, Artificial sequence
  SiRNA target sequence
gtgttctaatattgttctgccttata

SEQ ID NO: 237917 - DNA, 26 bp, Artificial sequence
  SiRNA target sequence
tgttctaatattgttctgccttatat

SEQ ID NO: 237918 - DNA, 26 bp, Artificial sequence
  SiRNA target sequence
gttctaatattgttctgccttatatg

SEQ ID NO: 237919 - DNA, 26 bp, Artificial sequence
  SiRNA target sequence
ttctaatattgttctgccttatatgg

SEQ ID NO: 237920 - DNA, 26 bp, Artificial sequence
  SiRNA target sequence
tctaatattgttctgccttatatggt

SEQ ID NO: 237921 - DNA, 26 bp, Artificial sequence
  SiRNA target sequence
ctaatattgttctgccttatatggtt

SEQ ID NO: 237922 - DNA, 26 bp, Artificial sequence
  SiRNA target sequence
taatattgttctgccttatatggttt

SEQ ID NO: 237923 - DNA, 26 bp, Artificial sequence
  SiRNA target sequence
aatattgttctgccttatatggtttt

SEQ ID NO: 237924 - DNA, 26 bp, Artificial sequence
  SiRNA target sequence
atattgttctgccttatatggtttta

SEQ ID NO: 237925 - DNA, 26 bp, Artificial sequence
  SiRNA target sequence
tattgttctgccttatatggttttat

SEQ ID NO: 237926 - DNA, 26 bp, Artificial sequence
  SiRNA target sequence
attgttctgccttatatggttttatt

SEQ ID NO: 237927 - DNA, 26 bp, Artificial sequence
  SiRNA target sequence
ttgttctgccttatatggttttattc

SEQ ID NO: 237928 - DNA, 26 bp, Artificial sequence
  SiRNA target sequence
tgttctgccttatatggttttattct

SEQ ID NO: 237929 - DNA, 26 bp, Artificial sequence
  SiRNA target sequence
gttctgccttatatggttttattctg

SEQ ID NO: 237930 - DNA, 26 bp, Artificial sequence
  SiRNA target sequence
ttctgccttatatggttttattctgt

SEQ ID NO: 237931 - DNA, 26 bp, Artificial sequence
  SiRNA target sequence
tctgccttatatggttttattctgtt

SEQ ID NO: 237932 - DNA, 26 bp, Artificial sequence
  SiRNA target sequence
ctgccttatatggttttattctgttt

SEQ ID NO: 237933 - DNA, 26 bp, Artificial sequence
  SiRNA target sequence
tgccttatatggttttattctgtttt

SEQ ID NO: 237934 - DNA, 26 bp, Artificial sequence
  SiRNA target sequence
gccttatatggttttattctgttttc

SEQ ID NO: 237935 - DNA, 26 bp, Artificial sequence
  SiRNA target sequence
ccttatatggttttattctgttttct

SEQ ID NO: 237936 - DNA, 26 bp, Artificial sequence
  SiRNA target sequence
cttatatggttttattctgttttcta

SEQ ID NO: 237937 - DNA, 26 bp, Artificial sequence
  SiRNA target sequence
ttatatggttttattctgttttctat

SEQ ID NO: 237938 - DNA, 26 bp, Artificial sequence
  SiRNA target sequence
tatatggttttattctgttttctatc

SEQ ID NO: 237939 - DNA, 26 bp, Artificial sequence
  SiRNA target sequence
atatggttttattctgttttctatct

SEQ ID NO: 237940 - DNA, 26 bp, Artificial sequence
  SiRNA target sequence
tatggttttattctgttttctatctc

SEQ ID NO: 237941 - DNA, 26 bp, Artificial sequence
  SiRNA target sequence
atggttttattctgttttctatctca

SEQ ID NO: 237942 - DNA, 26 bp, Artificial sequence
  SiRNA target sequence
tggttttattctgttttctatctcaa

SEQ ID NO: 237943 - DNA, 26 bp, Artificial sequence
  SiRNA target sequence
ggttttattctgttttctatctcaat

SEQ ID NO: 237944 - DNA, 26 bp, Artificial sequence
  SiRNA target sequence
gttttattctgttttctatctcaata

SEQ ID NO: 237945 - DNA, 26 bp, Artificial sequence
  SiRNA target sequence
ttttattctgttttctatctcaatag

SEQ ID NO: 237946 - DNA, 26 bp, Artificial sequence
  SiRNA target sequence
tttattctgttttctatctcaataga

SEQ ID NO: 237947 - DNA, 26 bp, Artificial sequence
  SiRNA target sequence
ttattctgttttctatctcaatagaa

SEQ ID NO: 237948 - DNA, 26 bp, Artificial sequence
  SiRNA target sequence
tattctgttttctatctcaatagaaa

SEQ ID NO: 237949 - DNA, 26 bp, Artificial sequence
  SiRNA target sequence
attctgttttctatctcaatagaaaa

SEQ ID NO: 237950 - DNA, 26 bp, Artificial sequence
  SiRNA target sequence
ttctgttttctatctcaatagaaaat

SEQ ID NO: 237951 - DNA, 26 bp, Artificial sequence
  SiRNA target sequence
tctgttttctatctcaatagaaaata

SEQ ID NO: 237952 - DNA, 26 bp, Artificial sequence
  SiRNA target sequence
ctgttttctatctcaatagaaaatat

SEQ ID NO: 237953 - DNA, 26 bp, Artificial sequence
  SiRNA target sequence
tgttttctatctcaatagaaaatata

SEQ ID NO: 237954 - DNA, 26 bp, Artificial sequence
  SiRNA target sequence
gttttctatctcaatagaaaatataa

SEQ ID NO: 237955 - DNA, 26 bp, Artificial sequence
  SiRNA target sequence
ttttctatctcaatagaaaatataaa

SEQ ID NO: 237956 - DNA, 26 bp, Artificial sequence
  SiRNA target sequence
tttctatctcaatagaaaatataaag

SEQ ID NO: 237957 - DNA, 26 bp, Artificial sequence
  SiRNA target sequence
ttctatctcaatagaaaatataaaga

SEQ ID NO: 237958 - DNA, 26 bp, Artificial sequence
  SiRNA target sequence
tctatctcaatagaaaatataaagaa

SEQ ID NO: 237959 - DNA, 26 bp, Artificial sequence
  SiRNA target sequence
ctatctcaatagaaaatataaagaat

SEQ ID NO: 237960 - DNA, 26 bp, Artificial sequence
  SiRNA target sequence
tatctcaatagaaaatataaagaatc

SEQ ID NO: 237961 - DNA, 26 bp, Artificial sequence
  SiRNA target sequence
atctcaatagaaaatataaagaatct

SEQ ID NO: 237962 - DNA, 26 bp, Artificial sequence
  SiRNA target sequence
tctcaatagaaaatataaagaatctg

SEQ ID NO: 237963 - DNA, 26 bp, Artificial sequence
  SiRNA target sequence
ctcaatagaaaatataaagaatctgt

SEQ ID NO: 237964 - DNA, 26 bp, Artificial sequence
  SiRNA target sequence
tcaatagaaaatataaagaatctgtc

SEQ ID NO: 237965 - DNA, 26 bp, Artificial sequence
  SiRNA target sequence
caatagaaaatataaagaatctgtcg

SEQ ID NO: 237966 - DNA, 26 bp, Artificial sequence
  SiRNA target sequence
aatagaaaatataaagaatctgtcga

SEQ ID NO: 237967 - DNA, 26 bp, Artificial sequence
  SiRNA target sequence
atagaaaatataaagaatctgtcgag

SEQ ID NO: 237968 - DNA, 26 bp, Artificial sequence
  SiRNA target sequence
tagaaaatataaagaatctgtcgaga

SEQ ID NO: 237969 - DNA, 26 bp, Artificial sequence
  SiRNA target sequence
agaaaatataaagaatctgtcgagaa

SEQ ID NO: 237970 - DNA, 26 bp, Artificial sequence
  SiRNA target sequence
gaaaatataaagaatctgtcgagaat

SEQ ID NO: 237971 - DNA, 26 bp, Artificial sequence
  SiRNA target sequence
aaaatataaagaatctgtcgagaata

SEQ ID NO: 237972 - DNA, 26 bp, Artificial sequence
  SiRNA target sequence
aaatataaagaatctgtcgagaataa

SEQ ID NO: 237973 - DNA, 26 bp, Artificial sequence
  SiRNA target sequence
aatataaagaatctgtcgagaataat

SEQ ID NO: 237974 - DNA, 26 bp, Artificial sequence
  SiRNA target sequence
atataaagaatctgtcgagaataatg

SEQ ID NO: 237975 - DNA, 26 bp, Artificial sequence
  SiRNA target sequence
tataaagaatctgtcgagaataatgc

SEQ ID NO: 237976 - DNA, 26 bp, Artificial sequence
  SiRNA target sequence
ataaagaatctgtcgagaataatgca

SEQ ID NO: 237977 - DNA, 26 bp, Artificial sequence
  SiRNA target sequence
taaagaatctgtcgagaataatgcac

SEQ ID NO: 237978 - DNA, 26 bp, Artificial sequence
  SiRNA target sequence
aaagaatctgtcgagaataatgcacc

SEQ ID NO: 237979 - DNA, 26 bp, Artificial sequence
  SiRNA target sequence
aagaatctgtcgagaataatgcacca

SEQ ID NO: 237980 - DNA, 26 bp, Artificial sequence
  SiRNA target sequence
agaatctgtcgagaataatgcaccaa

SEQ ID NO: 237981 - DNA, 26 bp, Artificial sequence
  SiRNA target sequence
gaatctgtcgagaataatgcaccaat

SEQ ID NO: 237982 - DNA, 26 bp, Artificial sequence
  SiRNA target sequence
aatctgtcgagaataatgcaccaatt

SEQ ID NO: 237983 - DNA, 26 bp, Artificial sequence
  SiRNA target sequence
atctgtcgagaataatgcaccaattg

SEQ ID NO: 237984 - DNA, 26 bp, Artificial sequence
  SiRNA target sequence
tctgtcgagaataatgcaccaattga

SEQ ID NO: 237985 - DNA, 26 bp, Artificial sequence
  SiRNA target sequence
ctgtcgagaataatgcaccaattgat

SEQ ID NO: 237986 - DNA, 26 bp, Artificial sequence
  SiRNA target sequence
tgtcgagaataatgcaccaattgata

SEQ ID NO: 237987 - DNA, 26 bp, Artificial sequence
  SiRNA target sequence
gtcgagaataatgcaccaattgatat

SEQ ID NO: 237988 - DNA, 26 bp, Artificial sequence
  SiRNA target sequence
tcgagaataatgcaccaattgatatt

SEQ ID NO: 237989 - DNA, 26 bp, Artificial sequence
  SiRNA target sequence
cgagaataatgcaccaattgatattg

SEQ ID NO: 237990 - DNA, 26 bp, Artificial sequence
  SiRNA target sequence
gagaataatgcaccaattgatattga

SEQ ID NO: 237991 - DNA, 26 bp, Artificial sequence
  SiRNA target sequence
agaataatgcaccaattgatattgat

SEQ ID NO: 237992 - DNA, 26 bp, Artificial sequence
  SiRNA target sequence
gaataatgcaccaattgatattgatt

SEQ ID NO: 237993 - DNA, 26 bp, Artificial sequence
  SiRNA target sequence
aataatgcaccaattgatattgattt

SEQ ID NO: 237994 - DNA, 26 bp, Artificial sequence
  SiRNA target sequence
ataatgcaccaattgatattgattta

SEQ ID NO: 237995 - DNA, 26 bp, Artificial sequence
  SiRNA target sequence
taatgcaccaattgatattgatttat

SEQ ID NO: 237996 - DNA, 26 bp, Artificial sequence
  SiRNA target sequence
aatgcaccaattgatattgatttatt

SEQ ID NO: 237997 - DNA, 26 bp, Artificial sequence
  SiRNA target sequence
atgcaccaattgatattgatttattc

SEQ ID NO: 237998 - DNA, 26 bp, Artificial sequence
  SiRNA target sequence
tgcaccaattgatattgatttattca

SEQ ID NO: 237999 - DNA, 26 bp, Artificial sequence
  SiRNA target sequence
gcaccaattgatattgatttattcac

SEQ ID NO: 238000 - DNA, 26 bp, Artificial sequence
  SiRNA target sequence
caccaattgatattgatttattcact

SEQ ID NO: 238001 - DNA, 26 bp, Artificial sequence
  SiRNA target sequence
accaattgatattgatttattcacta

SEQ ID NO: 238002 - DNA, 26 bp, Artificial sequence
  SiRNA target sequence
ccaattgatattgatttattcactag

SEQ ID NO: 238003 - DNA, 26 bp, Artificial sequence
  SiRNA target sequence
caattgatattgatttattcactagt

SEQ ID NO: 238004 - DNA, 26 bp, Artificial sequence
  SiRNA target sequence
aattgatattgatttattcactagtt

SEQ ID NO: 238005 - DNA, 26 bp, Artificial sequence
  SiRNA target sequence
attgatattgatttattcactagttc

SEQ ID NO: 238006 - DNA, 26 bp, Artificial sequence
  SiRNA target sequence
ttgatattgatttattcactagttca

SEQ ID NO: 238007 - DNA, 26 bp, Artificial sequence
  SiRNA target sequence
tgatattgatttattcactagttcaa

SEQ ID NO: 238008 - DNA, 26 bp, Artificial sequence
  SiRNA target sequence
gatattgatttattcactagttcaaa

SEQ ID NO: 238009 - DNA, 26 bp, Artificial sequence
  SiRNA target sequence
atattgatttattcactagttcaaaa

SEQ ID NO: 238010 - DNA, 26 bp, Artificial sequence
  SiRNA target sequence
tattgatttattcactagttcaaaag

SEQ ID NO: 238011 - DNA, 26 bp, Artificial sequence
  SiRNA target sequence
attgatttattcactagttcaaaagt

SEQ ID NO: 238012 - DNA, 26 bp, Artificial sequence
  SiRNA target sequence
ttgatttattcactagttcaaaagtc

SEQ ID NO: 238013 - DNA, 26 bp, Artificial sequence
  SiRNA target sequence
tgatttattcactagttcaaaagtca

SEQ ID NO: 238014 - DNA, 26 bp, Artificial sequence
  SiRNA target sequence
gatttattcactagttcaaaagtcaa

SEQ ID NO: 238015 - DNA, 26 bp, Artificial sequence
  SiRNA target sequence
atttattcactagttcaaaagtcaag

SEQ ID NO: 238016 - DNA, 26 bp, Artificial sequence
  SiRNA target sequence
tttattcactagttcaaaagtcaagg

SEQ ID NO: 238017 - DNA, 26 bp, Artificial sequence
  SiRNA target sequence
ttattcactagttcaaaagtcaaggc

SEQ ID NO: 238018 - DNA, 26 bp, Artificial sequence
  SiRNA target sequence
tattcactagttcaaaagtcaaggca

SEQ ID NO: 238019 - DNA, 26 bp, Artificial sequence
  SiRNA target sequence
attcactagttcaaaagtcaaggcac

SEQ ID NO: 238020 - DNA, 26 bp, Artificial sequence
  SiRNA target sequence
ttcactagttcaaaagtcaaggcacc

SEQ ID NO: 238021 - DNA, 26 bp, Artificial sequence
  SiRNA target sequence
tcactagttcaaaagtcaaggcacct

SEQ ID NO: 238022 - DNA, 26 bp, Artificial sequence
  SiRNA target sequence
cactagttcaaaagtcaaggcacctt

SEQ ID NO: 238023 - DNA, 26 bp, Artificial sequence
  SiRNA target sequence
actagttcaaaagtcaaggcaccttc

SEQ ID NO: 238024 - DNA, 26 bp, Artificial sequence
  SiRNA target sequence
ctagttcaaaagtcaaggcaccttct

SEQ ID NO: 238025 - DNA, 26 bp, Artificial sequence
  SiRNA target sequence
tagttcaaaagtcaaggcaccttctt

SEQ ID NO: 238026 - DNA, 26 bp, Artificial sequence
  SiRNA target sequence
agttcaaaagtcaaggcaccttcttc

SEQ ID NO: 238027 - DNA, 26 bp, Artificial sequence
  SiRNA target sequence
gttcaaaagtcaaggcaccttcttct

SEQ ID NO: 238028 - DNA, 26 bp, Artificial sequence
  SiRNA target sequence
ttcaaaagtcaaggcaccttcttctg

SEQ ID NO: 238029 - DNA, 26 bp, Artificial sequence
  SiRNA target sequence
tcaaaagtcaaggcaccttcttctga

SEQ ID NO: 238030 - DNA, 26 bp, Artificial sequence
  SiRNA target sequence
caaaagtcaaggcaccttcttctgaa

SEQ ID NO: 238031 - DNA, 26 bp, Artificial sequence
  SiRNA target sequence
aaaagtcaaggcaccttcttctgaac

SEQ ID NO: 238032 - DNA, 26 bp, Artificial sequence
  SiRNA target sequence
aaagtcaaggcaccttcttctgaacc

SEQ ID NO: 238033 - DNA, 26 bp, Artificial sequence
  SiRNA target sequence
aagtcaaggcaccttcttctgaacct

SEQ ID NO: 238034 - DNA, 26 bp, Artificial sequence
  SiRNA target sequence
agtcaaggcaccttcttctgaaccta

SEQ ID NO: 238035 - DNA, 26 bp, Artificial sequence
  SiRNA target sequence
gtcaaggcaccttcttctgaacctac

SEQ ID NO: 238036 - DNA, 26 bp, Artificial sequence
  SiRNA target sequence
tcaaggcaccttcttctgaacctact

SEQ ID NO: 238037 - DNA, 26 bp, Artificial sequence
  SiRNA target sequence
caaggcaccttcttctgaacctactg

SEQ ID NO: 238038 - DNA, 26 bp, Artificial sequence
  SiRNA target sequence
aaggcaccttcttctgaacctactgt

SEQ ID NO: 238039 - DNA, 26 bp, Artificial sequence
  SiRNA target sequence
aggcaccttcttctgaacctactgtt

SEQ ID NO: 238040 - DNA, 26 bp, Artificial sequence
  SiRNA target sequence
ggcaccttcttctgaacctactgttg

SEQ ID NO: 238041 - DNA, 26 bp, Artificial sequence
  SiRNA target sequence
gcaccttcttctgaacctactgttgc

SEQ ID NO: 238042 - DNA, 26 bp, Artificial sequence
  SiRNA target sequence
caccttcttctgaacctactgttgct

SEQ ID NO: 238043 - DNA, 26 bp, Artificial sequence
  SiRNA target sequence
accttcttctgaacctactgttgcta

SEQ ID NO: 238044 - DNA, 26 bp, Artificial sequence
  SiRNA target sequence
ccttcttctgaacctactgttgctac

SEQ ID NO: 238045 - DNA, 26 bp, Artificial sequence
  SiRNA target sequence
cttcttctgaacctactgttgctacc

SEQ ID NO: 238046 - DNA, 26 bp, Artificial sequence
  SiRNA target sequence
ttcttctgaacctactgttgctacca

SEQ ID NO: 238047 - DNA, 26 bp, Artificial sequence
  SiRNA target sequence
tcttctgaacctactgttgctaccaa

SEQ ID NO: 238048 - DNA, 26 bp, Artificial sequence
  SiRNA target sequence
cttctgaacctactgttgctaccaaa

SEQ ID NO: 238049 - DNA, 26 bp, Artificial sequence
  SiRNA target sequence
ttctgaacctactgttgctaccaaaa

SEQ ID NO: 238050 - DNA, 26 bp, Artificial sequence
  SiRNA target sequence
tctgaacctactgttgctaccaaaag

SEQ ID NO: 238051 - DNA, 26 bp, Artificial sequence
  SiRNA target sequence
ctgaacctactgttgctaccaaaagt

SEQ ID NO: 238052 - DNA, 26 bp, Artificial sequence
  SiRNA target sequence
tgaacctactgttgctaccaaaagtg

SEQ ID NO: 238053 - DNA, 26 bp, Artificial sequence
  SiRNA target sequence
gaacctactgttgctaccaaaagtgt

SEQ ID NO: 238054 - DNA, 26 bp, Artificial sequence
  SiRNA target sequence
aacctactgttgctaccaaaagtgtt

SEQ ID NO: 238055 - DNA, 26 bp, Artificial sequence
  SiRNA target sequence
acctactgttgctaccaaaagtgtta

SEQ ID NO: 238056 - DNA, 26 bp, Artificial sequence
  SiRNA target sequence
cctactgttgctaccaaaagtgttac

SEQ ID NO: 238057 - DNA, 26 bp, Artificial sequence
  SiRNA target sequence
ctactgttgctaccaaaagtgttact

SEQ ID NO: 238058 - DNA, 26 bp, Artificial sequence
  SiRNA target sequence
tactgttgctaccaaaagtgttacta

SEQ ID NO: 238059 - DNA, 26 bp, Artificial sequence
  SiRNA target sequence
actgttgctaccaaaagtgttactac

SEQ ID NO: 238060 - DNA, 26 bp, Artificial sequence
  SiRNA target sequence
ctgttgctaccaaaagtgttactaca

SEQ ID NO: 238061 - DNA, 26 bp, Artificial sequence
  SiRNA target sequence
tgttgctaccaaaagtgttactacag

SEQ ID NO: 238062 - DNA, 26 bp, Artificial sequence
  SiRNA target sequence
gttgctaccaaaagtgttactacaga

SEQ ID NO: 238063 - DNA, 26 bp, Artificial sequence
  SiRNA target sequence
ttgctaccaaaagtgttactacagaa

SEQ ID NO: 238064 - DNA, 26 bp, Artificial sequence
  SiRNA target sequence
tgctaccaaaagtgttactacagaag

SEQ ID NO: 238065 - DNA, 26 bp, Artificial sequence
  SiRNA target sequence
gctaccaaaagtgttactacagaaga

SEQ ID NO: 238066 - DNA, 26 bp, Artificial sequence
  SiRNA target sequence
ctaccaaaagtgttactacagaagaa

SEQ ID NO: 238067 - DNA, 26 bp, Artificial sequence
  SiRNA target sequence
taccaaaagtgttactacagaagaat

SEQ ID NO: 238068 - DNA, 26 bp, Artificial sequence
  SiRNA target sequence
accaaaagtgttactacagaagaata

SEQ ID NO: 238069 - DNA, 26 bp, Artificial sequence
  SiRNA target sequence
ccaaaagtgttactacagaagaataa

SEQ ID NO: 238070 - DNA, 27 bp, Artificial sequence
  SiRNA target sequence
atgtcagtagacaattcgaaagttcta

SEQ ID NO: 238071 - DNA, 27 bp, Artificial sequence
  SiRNA target sequence
tgtcagtagacaattcgaaagttctac

SEQ ID NO: 238072 - DNA, 27 bp, Artificial sequence
  SiRNA target sequence
gtcagtagacaattcgaaagttctaca

SEQ ID NO: 238073 - DNA, 27 bp, Artificial sequence
  SiRNA target sequence
tcagtagacaattcgaaagttctacaa

SEQ ID NO: 238074 - DNA, 27 bp, Artificial sequence
  SiRNA target sequence
cagtagacaattcgaaagttctacaaa

SEQ ID NO: 238075 - DNA, 27 bp, Artificial sequence
  SiRNA target sequence
agtagacaattcgaaagttctacaaaa

SEQ ID NO: 238076 - DNA, 27 bp, Artificial sequence
  SiRNA target sequence
gtagacaattcgaaagttctacaaaat

SEQ ID NO: 238077 - DNA, 27 bp, Artificial sequence
  SiRNA target sequence
tagacaattcgaaagttctacaaaata

SEQ ID NO: 238078 - DNA, 27 bp, Artificial sequence
  SiRNA target sequence
agacaattcgaaagttctacaaaataa

SEQ ID NO: 238079 - DNA, 27 bp, Artificial sequence
  SiRNA target sequence
gacaattcgaaagttctacaaaataac

SEQ ID NO: 238080 - DNA, 27 bp, Artificial sequence
  SiRNA target sequence
acaattcgaaagttctacaaaataacg

SEQ ID NO: 238081 - DNA, 27 bp, Artificial sequence
  SiRNA target sequence
caattcgaaagttctacaaaataacga

SEQ ID NO: 238082 - DNA, 27 bp, Artificial sequence
  SiRNA target sequence
aattcgaaagttctacaaaataacgaa

SEQ ID NO: 238083 - DNA, 27 bp, Artificial sequence
  SiRNA target sequence
attcgaaagttctacaaaataacgaaa

SEQ ID NO: 238084 - DNA, 27 bp, Artificial sequence
  SiRNA target sequence
ttcgaaagttctacaaaataacgaaaa

SEQ ID NO: 238085 - DNA, 27 bp, Artificial sequence
  SiRNA target sequence
tcgaaagttctacaaaataacgaaaac

SEQ ID NO: 238086 - DNA, 27 bp, Artificial sequence
  SiRNA target sequence
cgaaagttctacaaaataacgaaaact

SEQ ID NO: 238087 - DNA, 27 bp, Artificial sequence
  SiRNA target sequence
gaaagttctacaaaataacgaaaactc

SEQ ID NO: 238088 - DNA, 27 bp, Artificial sequence
  SiRNA target sequence
aaagttctacaaaataacgaaaactct

SEQ ID NO: 238089 - DNA, 27 bp, Artificial sequence
  SiRNA target sequence
aagttctacaaaataacgaaaactctg

SEQ ID NO: 238090 - DNA, 27 bp, Artificial sequence
  SiRNA target sequence
agttctacaaaataacgaaaactctgc

SEQ ID NO: 238091 - DNA, 27 bp, Artificial sequence
  SiRNA target sequence
gttctacaaaataacgaaaactctgct

SEQ ID NO: 238092 - DNA, 27 bp, Artificial sequence
  SiRNA target sequence
ttctacaaaataacgaaaactctgctc

SEQ ID NO: 238093 - DNA, 27 bp, Artificial sequence
  SiRNA target sequence
tctacaaaataacgaaaactctgctct

SEQ ID NO: 238094 - DNA, 27 bp, Artificial sequence
  SiRNA target sequence
ctacaaaataacgaaaactctgctctt

SEQ ID NO: 238095 - DNA, 27 bp, Artificial sequence
  SiRNA target sequence
tacaaaataacgaaaactctgctcttc

SEQ ID NO: 238096 - DNA, 27 bp, Artificial sequence
  SiRNA target sequence
acaaaataacgaaaactctgctcttcc

SEQ ID NO: 238097 - DNA, 27 bp, Artificial sequence
  SiRNA target sequence
caaaataacgaaaactctgctcttcct

SEQ ID NO: 238098 - DNA, 27 bp, Artificial sequence
  SiRNA target sequence
aaaataacgaaaactctgctcttccta

SEQ ID NO: 238099 - DNA, 27 bp, Artificial sequence
  SiRNA target sequence
aaataacgaaaactctgctcttcctac

SEQ ID NO: 238100 - DNA, 27 bp, Artificial sequence
  SiRNA target sequence
aataacgaaaactctgctcttcctaca

SEQ ID NO: 238101 - DNA, 27 bp, Artificial sequence
  SiRNA target sequence
ataacgaaaactctgctcttcctacag

SEQ ID NO: 238102 - DNA, 27 bp, Artificial sequence
  SiRNA target sequence
taacgaaaactctgctcttcctacaga

SEQ ID NO: 238103 - DNA, 27 bp, Artificial sequence
  SiRNA target sequence
aacgaaaactctgctcttcctacagaa

SEQ ID NO: 238104 - DNA, 27 bp, Artificial sequence
  SiRNA target sequence
acgaaaactctgctcttcctacagaag

SEQ ID NO: 238105 - DNA, 27 bp, Artificial sequence
  SiRNA target sequence
cgaaaactctgctcttcctacagaaga

SEQ ID NO: 238106 - DNA, 27 bp, Artificial sequence
  SiRNA target sequence
gaaaactctgctcttcctacagaagat

SEQ ID NO: 238107 - DNA, 27 bp, Artificial sequence
  SiRNA target sequence
aaaactctgctcttcctacagaagatg

SEQ ID NO: 238108 - DNA, 27 bp, Artificial sequence
  SiRNA target sequence
aaactctgctcttcctacagaagatga

SEQ ID NO: 238109 - DNA, 27 bp, Artificial sequence
  SiRNA target sequence
aactctgctcttcctacagaagatgaa

SEQ ID NO: 238110 - DNA, 27 bp, Artificial sequence
  SiRNA target sequence
actctgctcttcctacagaagatgaaa

SEQ ID NO: 238111 - DNA, 27 bp, Artificial sequence
  SiRNA target sequence
ctctgctcttcctacagaagatgaaat

SEQ ID NO: 238112 - DNA, 27 bp, Artificial sequence
  SiRNA target sequence
tctgctcttcctacagaagatgaaatt

SEQ ID NO: 238113 - DNA, 27 bp, Artificial sequence
  SiRNA target sequence
ctgctcttcctacagaagatgaaattg

SEQ ID NO: 238114 - DNA, 27 bp, Artificial sequence
  SiRNA target sequence
tgctcttcctacagaagatgaaattga

SEQ ID NO: 238115 - DNA, 27 bp, Artificial sequence
  SiRNA target sequence
gctcttcctacagaagatgaaattgag

SEQ ID NO: 238116 - DNA, 27 bp, Artificial sequence
  SiRNA target sequence
ctcttcctacagaagatgaaattgagt

SEQ ID NO: 238117 - DNA, 27 bp, Artificial sequence
  SiRNA target sequence
tcttcctacagaagatgaaattgagta

SEQ ID NO: 238118 - DNA, 27 bp, Artificial sequence
  SiRNA target sequence
cttcctacagaagatgaaattgagtat

SEQ ID NO: 238119 - DNA, 27 bp, Artificial sequence
  SiRNA target sequence
ttcctacagaagatgaaattgagtatg

SEQ ID NO: 238120 - DNA, 27 bp, Artificial sequence
  SiRNA target sequence
tcctacagaagatgaaattgagtatga

SEQ ID NO: 238121 - DNA, 27 bp, Artificial sequence
  SiRNA target sequence
cctacagaagatgaaattgagtatgag

SEQ ID NO: 238122 - DNA, 27 bp, Artificial sequence
  SiRNA target sequence
ctacagaagatgaaattgagtatgagg

SEQ ID NO: 238123 - DNA, 27 bp, Artificial sequence
  SiRNA target sequence
tacagaagatgaaattgagtatgaggc

SEQ ID NO: 238124 - DNA, 27 bp, Artificial sequence
  SiRNA target sequence
acagaagatgaaattgagtatgaggcc

SEQ ID NO: 238125 - DNA, 27 bp, Artificial sequence
  SiRNA target sequence
cagaagatgaaattgagtatgaggcca

SEQ ID NO: 238126 - DNA, 27 bp, Artificial sequence
  SiRNA target sequence
agaagatgaaattgagtatgaggccag

SEQ ID NO: 238127 - DNA, 27 bp, Artificial sequence
  SiRNA target sequence
gaagatgaaattgagtatgaggccagc

SEQ ID NO: 238128 - DNA, 27 bp, Artificial sequence
  SiRNA target sequence
aagatgaaattgagtatgaggccagca

SEQ ID NO: 238129 - DNA, 27 bp, Artificial sequence
  SiRNA target sequence
agatgaaattgagtatgaggccagcaa

SEQ ID NO: 238130 - DNA, 27 bp, Artificial sequence
  SiRNA target sequence
gatgaaattgagtatgaggccagcaat

SEQ ID NO: 238131 - DNA, 27 bp, Artificial sequence
  SiRNA target sequence
atgaaattgagtatgaggccagcaatg

SEQ ID NO: 238132 - DNA, 27 bp, Artificial sequence
  SiRNA target sequence
tgaaattgagtatgaggccagcaatgg

SEQ ID NO: 238133 - DNA, 27 bp, Artificial sequence
  SiRNA target sequence
gaaattgagtatgaggccagcaatggt

SEQ ID NO: 238134 - DNA, 27 bp, Artificial sequence
  SiRNA target sequence
aaattgagtatgaggccagcaatggtt

SEQ ID NO: 238135 - DNA, 27 bp, Artificial sequence
  SiRNA target sequence
aattgagtatgaggccagcaatggttc

SEQ ID NO: 238136 - DNA, 27 bp, Artificial sequence
  SiRNA target sequence
attgagtatgaggccagcaatggttct

SEQ ID NO: 238137 - DNA, 27 bp, Artificial sequence
  SiRNA target sequence
ttgagtatgaggccagcaatggttctg

SEQ ID NO: 238138 - DNA, 27 bp, Artificial sequence
  SiRNA target sequence
tgagtatgaggccagcaatggttctgg

SEQ ID NO: 238139 - DNA, 27 bp, Artificial sequence
  SiRNA target sequence
gagtatgaggccagcaatggttctggt

SEQ ID NO: 238140 - DNA, 27 bp, Artificial sequence
  SiRNA target sequence
agtatgaggccagcaatggttctggta

SEQ ID NO: 238141 - DNA, 27 bp, Artificial sequence
  SiRNA target sequence
gtatgaggccagcaatggttctggtat

SEQ ID NO: 238142 - DNA, 27 bp, Artificial sequence
  SiRNA target sequence
tatgaggccagcaatggttctggtata

SEQ ID NO: 238143 - DNA, 27 bp, Artificial sequence
  SiRNA target sequence
atgaggccagcaatggttctggtatat

SEQ ID NO: 238144 - DNA, 27 bp, Artificial sequence
  SiRNA target sequence
tgaggccagcaatggttctggtatata

SEQ ID NO: 238145 - DNA, 27 bp, Artificial sequence
  SiRNA target sequence
gaggccagcaatggttctggtatatat

SEQ ID NO: 238146 - DNA, 27 bp, Artificial sequence
  SiRNA target sequence
aggccagcaatggttctggtatatatt

SEQ ID NO: 238147 - DNA, 27 bp, Artificial sequence
  SiRNA target sequence
ggccagcaatggttctggtatatattc

SEQ ID NO: 238148 - DNA, 27 bp, Artificial sequence
  SiRNA target sequence
gccagcaatggttctggtatatattca

SEQ ID NO: 238149 - DNA, 27 bp, Artificial sequence
  SiRNA target sequence
ccagcaatggttctggtatatattcac

SEQ ID NO: 238150 - DNA, 27 bp, Artificial sequence
  SiRNA target sequence
cagcaatggttctggtatatattcact

SEQ ID NO: 238151 - DNA, 27 bp, Artificial sequence
  SiRNA target sequence
agcaatggttctggtatatattcactt

SEQ ID NO: 238152 - DNA, 27 bp, Artificial sequence
  SiRNA target sequence
gcaatggttctggtatatattcactta

SEQ ID NO: 238153 - DNA, 27 bp, Artificial sequence
  SiRNA target sequence
caatggttctggtatatattcacttat

SEQ ID NO: 238154 - DNA, 27 bp, Artificial sequence
  SiRNA target sequence
aatggttctggtatatattcacttatt

SEQ ID NO: 238155 - DNA, 27 bp, Artificial sequence
  SiRNA target sequence
atggttctggtatatattcacttatta

SEQ ID NO: 238156 - DNA, 27 bp, Artificial sequence
  SiRNA target sequence
tggttctggtatatattcacttattag

SEQ ID NO: 238157 - DNA, 27 bp, Artificial sequence
  SiRNA target sequence
ggttctggtatatattcacttattaga

SEQ ID NO: 238158 - DNA, 27 bp, Artificial sequence
  SiRNA target sequence
gttctggtatatattcacttattagag

SEQ ID NO: 238159 - DNA, 27 bp, Artificial sequence
  SiRNA target sequence
ttctggtatatattcacttattagagt

SEQ ID NO: 238160 - DNA, 27 bp, Artificial sequence
  SiRNA target sequence
tctggtatatattcacttattagagta

SEQ ID NO: 238161 - DNA, 27 bp, Artificial sequence
  SiRNA target sequence
ctggtatatattcacttattagagtag

SEQ ID NO: 238162 - DNA, 27 bp, Artificial sequence
  SiRNA target sequence
tggtatatattcacttattagagtagc

SEQ ID NO: 238163 - DNA, 27 bp, Artificial sequence
  SiRNA target sequence
ggtatatattcacttattagagtagca

SEQ ID NO: 238164 - DNA, 27 bp, Artificial sequence
  SiRNA target sequence
gtatatattcacttattagagtagcaa

SEQ ID NO: 238165 - DNA, 27 bp, Artificial sequence
  SiRNA target sequence
tatatattcacttattagagtagcaaa

SEQ ID NO: 238166 - DNA, 27 bp, Artificial sequence
  SiRNA target sequence
atatattcacttattagagtagcaaag

SEQ ID NO: 238167 - DNA, 27 bp, Artificial sequence
  SiRNA target sequence
tatattcacttattagagtagcaaagg

SEQ ID NO: 238168 - DNA, 27 bp, Artificial sequence
  SiRNA target sequence
atattcacttattagagtagcaaaggt

SEQ ID NO: 238169 - DNA, 27 bp, Artificial sequence
  SiRNA target sequence
tattcacttattagagtagcaaaggtt

SEQ ID NO: 238170 - DNA, 27 bp, Artificial sequence
  SiRNA target sequence
attcacttattagagtagcaaaggttg

SEQ ID NO: 238171 - DNA, 27 bp, Artificial sequence
  SiRNA target sequence
ttcacttattagagtagcaaaggttga

SEQ ID NO: 238172 - DNA, 27 bp, Artificial sequence
  SiRNA target sequence
tcacttattagagtagcaaaggttgag

SEQ ID NO: 238173 - DNA, 27 bp, Artificial sequence
  SiRNA target sequence
cacttattagagtagcaaaggttgaga

SEQ ID NO: 238174 - DNA, 27 bp, Artificial sequence
  SiRNA target sequence
acttattagagtagcaaaggttgagag

SEQ ID NO: 238175 - DNA, 27 bp, Artificial sequence
  SiRNA target sequence
cttattagagtagcaaaggttgagaga

SEQ ID NO: 238176 - DNA, 27 bp, Artificial sequence
  SiRNA target sequence
ttattagagtagcaaaggttgagagaa

SEQ ID NO: 238177 - DNA, 27 bp, Artificial sequence
  SiRNA target sequence
tattagagtagcaaaggttgagagaaa

SEQ ID NO: 238178 - DNA, 27 bp, Artificial sequence
  SiRNA target sequence
attagagtagcaaaggttgagagaaag

SEQ ID NO: 238179 - DNA, 27 bp, Artificial sequence
  SiRNA target sequence
ttagagtagcaaaggttgagagaaaga

SEQ ID NO: 238180 - DNA, 27 bp, Artificial sequence
  SiRNA target sequence
tagagtagcaaaggttgagagaaagat

SEQ ID NO: 238181 - DNA, 27 bp, Artificial sequence
  SiRNA target sequence
agagtagcaaaggttgagagaaagatg

SEQ ID NO: 238182 - DNA, 27 bp, Artificial sequence
  SiRNA target sequence
gagtagcaaaggttgagagaaagatgt

SEQ ID NO: 238183 - DNA, 27 bp, Artificial sequence
  SiRNA target sequence
agtagcaaaggttgagagaaagatgtt

SEQ ID NO: 238184 - DNA, 27 bp, Artificial sequence
  SiRNA target sequence
gtagcaaaggttgagagaaagatgttt

SEQ ID NO: 238185 - DNA, 27 bp, Artificial sequence
  SiRNA target sequence
tagcaaaggttgagagaaagatgtttt

SEQ ID NO: 238186 - DNA, 27 bp, Artificial sequence
  SiRNA target sequence
agcaaaggttgagagaaagatgttttg

SEQ ID NO: 238187 - DNA, 27 bp, Artificial sequence
  SiRNA target sequence
gcaaaggttgagagaaagatgttttgg

SEQ ID NO: 238188 - DNA, 27 bp, Artificial sequence
  SiRNA target sequence
caaaggttgagagaaagatgttttgga

SEQ ID NO: 238189 - DNA, 27 bp, Artificial sequence
  SiRNA target sequence
aaaggttgagagaaagatgttttggat

SEQ ID NO: 238190 - DNA, 27 bp, Artificial sequence
  SiRNA target sequence
aaggttgagagaaagatgttttggatc

SEQ ID NO: 238191 - DNA, 27 bp, Artificial sequence
  SiRNA target sequence
aggttgagagaaagatgttttggatca

SEQ ID NO: 238192 - DNA, 27 bp, Artificial sequence
  SiRNA target sequence
ggttgagagaaagatgttttggatcat

SEQ ID NO: 238193 - DNA, 27 bp, Artificial sequence
  SiRNA target sequence
gttgagagaaagatgttttggatcatg

SEQ ID NO: 238194 - DNA, 27 bp, Artificial sequence
  SiRNA target sequence
ttgagagaaagatgttttggatcatgg

SEQ ID NO: 238195 - DNA, 27 bp, Artificial sequence
  SiRNA target sequence
tgagagaaagatgttttggatcatggc

SEQ ID NO: 238196 - DNA, 27 bp, Artificial sequence
  SiRNA target sequence
gagagaaagatgttttggatcatggca

SEQ ID NO: 238197 - DNA, 27 bp, Artificial sequence
  SiRNA target sequence
agagaaagatgttttggatcatggcag

SEQ ID NO: 238198 - DNA, 27 bp, Artificial sequence
  SiRNA target sequence
gagaaagatgttttggatcatggcagc

SEQ ID NO: 238199 - DNA, 27 bp, Artificial sequence
  SiRNA target sequence
agaaagatgttttggatcatggcagct

SEQ ID NO: 238200 - DNA, 27 bp, Artificial sequence
  SiRNA target sequence
gaaagatgttttggatcatggcagcta

SEQ ID NO: 238201 - DNA, 27 bp, Artificial sequence
  SiRNA target sequence
aaagatgttttggatcatggcagctat

SEQ ID NO: 238202 - DNA, 27 bp, Artificial sequence
  SiRNA target sequence
aagatgttttggatcatggcagctatg

SEQ ID NO: 238203 - DNA, 27 bp, Artificial sequence
  SiRNA target sequence
agatgttttggatcatggcagctatgt

SEQ ID NO: 238204 - DNA, 27 bp, Artificial sequence
  SiRNA target sequence
gatgttttggatcatggcagctatgtt

SEQ ID NO: 238205 - DNA, 27 bp, Artificial sequence
  SiRNA target sequence
atgttttggatcatggcagctatgttc

SEQ ID NO: 238206 - DNA, 27 bp, Artificial sequence
  SiRNA target sequence
tgttttggatcatggcagctatgttct

SEQ ID NO: 238207 - DNA, 27 bp, Artificial sequence
  SiRNA target sequence
gttttggatcatggcagctatgttctt

SEQ ID NO: 238208 - DNA, 27 bp, Artificial sequence
  SiRNA target sequence
ttttggatcatggcagctatgttcttt

SEQ ID NO: 238209 - DNA, 27 bp, Artificial sequence
  SiRNA target sequence
tttggatcatggcagctatgttcttta

SEQ ID NO: 238210 - DNA, 27 bp, Artificial sequence
  SiRNA target sequence
ttggatcatggcagctatgttctttat

SEQ ID NO: 238211 - DNA, 27 bp, Artificial sequence
  SiRNA target sequence
tggatcatggcagctatgttctttatt

SEQ ID NO: 238212 - DNA, 27 bp, Artificial sequence
  SiRNA target sequence
ggatcatggcagctatgttctttatta

SEQ ID NO: 238213 - DNA, 27 bp, Artificial sequence
  SiRNA target sequence
gatcatggcagctatgttctttattat

SEQ ID NO: 238214 - DNA, 27 bp, Artificial sequence
  SiRNA target sequence
atcatggcagctatgttctttattatc

SEQ ID NO: 238215 - DNA, 27 bp, Artificial sequence
  SiRNA target sequence
tcatggcagctatgttctttattatct

SEQ ID NO: 238216 - DNA, 27 bp, Artificial sequence
  SiRNA target sequence
catggcagctatgttctttattatctc

SEQ ID NO: 238217 - DNA, 27 bp, Artificial sequence
  SiRNA target sequence
atggcagctatgttctttattatctcc

SEQ ID NO: 238218 - DNA, 27 bp, Artificial sequence
  SiRNA target sequence
tggcagctatgttctttattatctcct

SEQ ID NO: 238219 - DNA, 27 bp, Artificial sequence
  SiRNA target sequence
ggcagctatgttctttattatctcctt

SEQ ID NO: 238220 - DNA, 27 bp, Artificial sequence
  SiRNA target sequence
gcagctatgttctttattatctccttt

SEQ ID NO: 238221 - DNA, 27 bp, Artificial sequence
  SiRNA target sequence
cagctatgttctttattatctccttta

SEQ ID NO: 238222 - DNA, 27 bp, Artificial sequence
  SiRNA target sequence
agctatgttctttattatctcctttat

SEQ ID NO: 238223 - DNA, 27 bp, Artificial sequence
  SiRNA target sequence
gctatgttctttattatctcctttatt

SEQ ID NO: 238224 - DNA, 27 bp, Artificial sequence
  SiRNA target sequence
ctatgttctttattatctcctttattt

SEQ ID NO: 238225 - DNA, 27 bp, Artificial sequence
  SiRNA target sequence
tatgttctttattatctcctttattta

SEQ ID NO: 238226 - DNA, 27 bp, Artificial sequence
  SiRNA target sequence
atgttctttattatctcctttatttat

SEQ ID NO: 238227 - DNA, 27 bp, Artificial sequence
  SiRNA target sequence
tgttctttattatctcctttatttatt

SEQ ID NO: 238228 - DNA, 27 bp, Artificial sequence
  SiRNA target sequence
gttctttattatctcctttatttattc

SEQ ID NO: 238229 - DNA, 27 bp, Artificial sequence
  SiRNA target sequence
ttctttattatctcctttatttattcg

SEQ ID NO: 238230 - DNA, 27 bp, Artificial sequence
  SiRNA target sequence
tctttattatctcctttatttattcgg

SEQ ID NO: 238231 - DNA, 27 bp, Artificial sequence
  SiRNA target sequence
ctttattatctcctttatttattcggt

SEQ ID NO: 238232 - DNA, 27 bp, Artificial sequence
  SiRNA target sequence
tttattatctcctttatttattcggtg

SEQ ID NO: 238233 - DNA, 27 bp, Artificial sequence
  SiRNA target sequence
ttattatctcctttatttattcggtgg

SEQ ID NO: 238234 - DNA, 27 bp, Artificial sequence
  SiRNA target sequence
tattatctcctttatttattcggtggc

SEQ ID NO: 238235 - DNA, 27 bp, Artificial sequence
  SiRNA target sequence
attatctcctttatttattcggtggct

SEQ ID NO: 238236 - DNA, 27 bp, Artificial sequence
  SiRNA target sequence
ttatctcctttatttattcggtggcta

SEQ ID NO: 238237 - DNA, 27 bp, Artificial sequence
  SiRNA target sequence
tatctcctttatttattcggtggctag

SEQ ID NO: 238238 - DNA, 27 bp, Artificial sequence
  SiRNA target sequence
atctcctttatttattcggtggctaga

SEQ ID NO: 238239 - DNA, 27 bp, Artificial sequence
  SiRNA target sequence
tctcctttatttattcggtggctagag

SEQ ID NO: 238240 - DNA, 27 bp, Artificial sequence
  SiRNA target sequence
ctcctttatttattcggtggctagagt

SEQ ID NO: 238241 - DNA, 27 bp, Artificial sequence
  SiRNA target sequence
tcctttatttattcggtggctagagtg

SEQ ID NO: 238242 - DNA, 27 bp, Artificial sequence
  SiRNA target sequence
cctttatttattcggtggctagagtgc

SEQ ID NO: 238243 - DNA, 27 bp, Artificial sequence
  SiRNA target sequence
ctttatttattcggtggctagagtgct

SEQ ID NO: 238244 - DNA, 27 bp, Artificial sequence
  SiRNA target sequence
tttatttattcggtggctagagtgctt

SEQ ID NO: 238245 - DNA, 27 bp, Artificial sequence
  SiRNA target sequence
ttatttattcggtggctagagtgctta

SEQ ID NO: 238246 - DNA, 27 bp, Artificial sequence
  SiRNA target sequence
tatttattcggtggctagagtgcttaa

SEQ ID NO: 238247 - DNA, 27 bp, Artificial sequence
  SiRNA target sequence
atttattcggtggctagagtgcttaaa

SEQ ID NO: 238248 - DNA, 27 bp, Artificial sequence
  SiRNA target sequence
tttattcggtggctagagtgcttaaag

SEQ ID NO: 238249 - DNA, 27 bp, Artificial sequence
  SiRNA target sequence
ttattcggtggctagagtgcttaaaga

SEQ ID NO: 238250 - DNA, 27 bp, Artificial sequence
  SiRNA target sequence
tattcggtggctagagtgcttaaagat

SEQ ID NO: 238251 - DNA, 27 bp, Artificial sequence
  SiRNA target sequence
attcggtggctagagtgcttaaagatg

SEQ ID NO: 238252 - DNA, 27 bp, Artificial sequence
  SiRNA target sequence
ttcggtggctagagtgcttaaagatgc

SEQ ID NO: 238253 - DNA, 27 bp, Artificial sequence
  SiRNA target sequence
tcggtggctagagtgcttaaagatgcc

SEQ ID NO: 238254 - DNA, 27 bp, Artificial sequence
  SiRNA target sequence
cggtggctagagtgcttaaagatgccg

SEQ ID NO: 238255 - DNA, 27 bp, Artificial sequence
  SiRNA target sequence
ggtggctagagtgcttaaagatgccgc

SEQ ID NO: 238256 - DNA, 27 bp, Artificial sequence
  SiRNA target sequence
gtggctagagtgcttaaagatgccgct

SEQ ID NO: 238257 - DNA, 27 bp, Artificial sequence
  SiRNA target sequence
tggctagagtgcttaaagatgccgctg

SEQ ID NO: 238258 - DNA, 27 bp, Artificial sequence
  SiRNA target sequence
ggctagagtgcttaaagatgccgctgt

SEQ ID NO: 238259 - DNA, 27 bp, Artificial sequence
  SiRNA target sequence
gctagagtgcttaaagatgccgctgtt

SEQ ID NO: 238260 - DNA, 27 bp, Artificial sequence
  SiRNA target sequence
ctagagtgcttaaagatgccgctgtta

SEQ ID NO: 238261 - DNA, 27 bp, Artificial sequence
  SiRNA target sequence
tagagtgcttaaagatgccgctgttat

SEQ ID NO: 238262 - DNA, 27 bp, Artificial sequence
  SiRNA target sequence
agagtgcttaaagatgccgctgttatt

SEQ ID NO: 238263 - DNA, 27 bp, Artificial sequence
  SiRNA target sequence
gagtgcttaaagatgccgctgttattg

SEQ ID NO: 238264 - DNA, 27 bp, Artificial sequence
  SiRNA target sequence
agtgcttaaagatgccgctgttattgg

SEQ ID NO: 238265 - DNA, 27 bp, Artificial sequence
  SiRNA target sequence
gtgcttaaagatgccgctgttattggt

SEQ ID NO: 238266 - DNA, 27 bp, Artificial sequence
  SiRNA target sequence
tgcttaaagatgccgctgttattggta

SEQ ID NO: 238267 - DNA, 27 bp, Artificial sequence
  SiRNA target sequence
gcttaaagatgccgctgttattggtaa

SEQ ID NO: 238268 - DNA, 27 bp, Artificial sequence
  SiRNA target sequence
cttaaagatgccgctgttattggtaaa

SEQ ID NO: 238269 - DNA, 27 bp, Artificial sequence
  SiRNA target sequence
ttaaagatgccgctgttattggtaaac

SEQ ID NO: 238270 - DNA, 27 bp, Artificial sequence
  SiRNA target sequence
taaagatgccgctgttattggtaaaca

SEQ ID NO: 238271 - DNA, 27 bp, Artificial sequence
  SiRNA target sequence
aaagatgccgctgttattggtaaacaa

SEQ ID NO: 238272 - DNA, 27 bp, Artificial sequence
  SiRNA target sequence
aagatgccgctgttattggtaaacaac

SEQ ID NO: 238273 - DNA, 27 bp, Artificial sequence
  SiRNA target sequence
agatgccgctgttattggtaaacaact

SEQ ID NO: 238274 - DNA, 27 bp, Artificial sequence
  SiRNA target sequence
gatgccgctgttattggtaaacaactc

SEQ ID NO: 238275 - DNA, 27 bp, Artificial sequence
  SiRNA target sequence
atgccgctgttattggtaaacaactcc

SEQ ID NO: 238276 - DNA, 27 bp, Artificial sequence
  SiRNA target sequence
tgccgctgttattggtaaacaactccc

SEQ ID NO: 238277 - DNA, 27 bp, Artificial sequence
  SiRNA target sequence
gccgctgttattggtaaacaactccca

SEQ ID NO: 238278 - DNA, 27 bp, Artificial sequence
  SiRNA target sequence
ccgctgttattggtaaacaactcccag

SEQ ID NO: 238279 - DNA, 27 bp, Artificial sequence
  SiRNA target sequence
cgctgttattggtaaacaactcccagc

SEQ ID NO: 238280 - DNA, 27 bp, Artificial sequence
  SiRNA target sequence
gctgttattggtaaacaactcccagcg

SEQ ID NO: 238281 - DNA, 27 bp, Artificial sequence
  SiRNA target sequence
ctgttattggtaaacaactcccagcgt

SEQ ID NO: 238282 - DNA, 27 bp, Artificial sequence
  SiRNA target sequence
tgttattggtaaacaactcccagcgtc

SEQ ID NO: 238283 - DNA, 27 bp, Artificial sequence
  SiRNA target sequence
gttattggtaaacaactcccagcgtca

SEQ ID NO: 238284 - DNA, 27 bp, Artificial sequence
  SiRNA target sequence
ttattggtaaacaactcccagcgtcaa

SEQ ID NO: 238285 - DNA, 27 bp, Artificial sequence
  SiRNA target sequence
tattggtaaacaactcccagcgtcaat

SEQ ID NO: 238286 - DNA, 27 bp, Artificial sequence
  SiRNA target sequence
attggtaaacaactcccagcgtcaatt

SEQ ID NO: 238287 - DNA, 27 bp, Artificial sequence
  SiRNA target sequence
ttggtaaacaactcccagcgtcaattt

SEQ ID NO: 238288 - DNA, 27 bp, Artificial sequence
  SiRNA target sequence
tggtaaacaactcccagcgtcaatttt

SEQ ID NO: 238289 - DNA, 27 bp, Artificial sequence
  SiRNA target sequence
ggtaaacaactcccagcgtcaattttc

SEQ ID NO: 238290 - DNA, 27 bp, Artificial sequence
  SiRNA target sequence
gtaaacaactcccagcgtcaattttct

SEQ ID NO: 238291 - DNA, 27 bp, Artificial sequence
  SiRNA target sequence
taaacaactcccagcgtcaattttctt

SEQ ID NO: 238292 - DNA, 27 bp, Artificial sequence
  SiRNA target sequence
aaacaactcccagcgtcaattttcttt

SEQ ID NO: 238293 - DNA, 27 bp, Artificial sequence
  SiRNA target sequence
aacaactcccagcgtcaattttctttt

SEQ ID NO: 238294 - DNA, 27 bp, Artificial sequence
  SiRNA target sequence
acaactcccagcgtcaattttcttttt

SEQ ID NO: 238295 - DNA, 27 bp, Artificial sequence
  SiRNA target sequence
caactcccagcgtcaattttctttttg

SEQ ID NO: 238296 - DNA, 27 bp, Artificial sequence
  SiRNA target sequence
aactcccagcgtcaattttctttttga

SEQ ID NO: 238297 - DNA, 27 bp, Artificial sequence
  SiRNA target sequence
actcccagcgtcaattttctttttgaa

SEQ ID NO: 238298 - DNA, 27 bp, Artificial sequence
  SiRNA target sequence
ctcccagcgtcaattttctttttgaaa

SEQ ID NO: 238299 - DNA, 27 bp, Artificial sequence
  SiRNA target sequence
tcccagcgtcaattttctttttgaaat

SEQ ID NO: 238300 - DNA, 27 bp, Artificial sequence
  SiRNA target sequence
cccagcgtcaattttctttttgaaatt

SEQ ID NO: 238301 - DNA, 27 bp, Artificial sequence
  SiRNA target sequence
ccagcgtcaattttctttttgaaattt

SEQ ID NO: 238302 - DNA, 27 bp, Artificial sequence
  SiRNA target sequence
cagcgtcaattttctttttgaaatttg

SEQ ID NO: 238303 - DNA, 27 bp, Artificial sequence
  SiRNA target sequence
agcgtcaattttctttttgaaatttgt

SEQ ID NO: 238304 - DNA, 27 bp, Artificial sequence
  SiRNA target sequence
gcgtcaattttctttttgaaatttgtt

SEQ ID NO: 238305 - DNA, 27 bp, Artificial sequence
  SiRNA target sequence
cgtcaattttctttttgaaatttgtta

SEQ ID NO: 238306 - DNA, 27 bp, Artificial sequence
  SiRNA target sequence
gtcaattttctttttgaaatttgttat

SEQ ID NO: 238307 - DNA, 27 bp, Artificial sequence
  SiRNA target sequence
tcaattttctttttgaaatttgttatt

SEQ ID NO: 238308 - DNA, 27 bp, Artificial sequence
  SiRNA target sequence
caattttctttttgaaatttgttatta

SEQ ID NO: 238309 - DNA, 27 bp, Artificial sequence
  SiRNA target sequence
aattttctttttgaaatttgttattat

SEQ ID NO: 238310 - DNA, 27 bp, Artificial sequence
  SiRNA target sequence
attttctttttgaaatttgttattatc

SEQ ID NO: 238311 - DNA, 27 bp, Artificial sequence
  SiRNA target sequence
ttttctttttgaaatttgttattatcc

SEQ ID NO: 238312 - DNA, 27 bp, Artificial sequence
  SiRNA target sequence
tttctttttgaaatttgttattatcct

SEQ ID NO: 238313 - DNA, 27 bp, Artificial sequence
  SiRNA target sequence
ttctttttgaaatttgttattatcctt

SEQ ID NO: 238314 - DNA, 27 bp, Artificial sequence
  SiRNA target sequence
tctttttgaaatttgttattatccttc

SEQ ID NO: 238315 - DNA, 27 bp, Artificial sequence
  SiRNA target sequence
ctttttgaaatttgttattatccttcc

SEQ ID NO: 238316 - DNA, 27 bp, Artificial sequence
  SiRNA target sequence
tttttgaaatttgttattatccttccg

SEQ ID NO: 238317 - DNA, 27 bp, Artificial sequence
  SiRNA target sequence
ttttgaaatttgttattatccttccgt

SEQ ID NO: 238318 - DNA, 27 bp, Artificial sequence
  SiRNA target sequence
tttgaaatttgttattatccttccgtt

SEQ ID NO: 238319 - DNA, 27 bp, Artificial sequence
  SiRNA target sequence
ttgaaatttgttattatccttccgttc

SEQ ID NO: 238320 - DNA, 27 bp, Artificial sequence
  SiRNA target sequence
tgaaatttgttattatccttccgttct

SEQ ID NO: 238321 - DNA, 27 bp, Artificial sequence
  SiRNA target sequence
gaaatttgttattatccttccgttctc

SEQ ID NO: 238322 - DNA, 27 bp, Artificial sequence
  SiRNA target sequence
aaatttgttattatccttccgttctca

SEQ ID NO: 238323 - DNA, 27 bp, Artificial sequence
  SiRNA target sequence
aatttgttattatccttccgttctcat

SEQ ID NO: 238324 - DNA, 27 bp, Artificial sequence
  SiRNA target sequence
atttgttattatccttccgttctcatt

SEQ ID NO: 238325 - DNA, 27 bp, Artificial sequence
  SiRNA target sequence
tttgttattatccttccgttctcattt

SEQ ID NO: 238326 - DNA, 27 bp, Artificial sequence
  SiRNA target sequence
ttgttattatccttccgttctcattta

SEQ ID NO: 238327 - DNA, 27 bp, Artificial sequence
  SiRNA target sequence
tgttattatccttccgttctcatttat

SEQ ID NO: 238328 - DNA, 27 bp, Artificial sequence
  SiRNA target sequence
gttattatccttccgttctcatttatt

SEQ ID NO: 238329 - DNA, 27 bp, Artificial sequence
  SiRNA target sequence
ttattatccttccgttctcatttattt

SEQ ID NO: 238330 - DNA, 27 bp, Artificial sequence
  SiRNA target sequence
tattatccttccgttctcatttatttc

SEQ ID NO: 238331 - DNA, 27 bp, Artificial sequence
  SiRNA target sequence
attatccttccgttctcatttatttca

SEQ ID NO: 238332 - DNA, 27 bp, Artificial sequence
  SiRNA target sequence
ttatccttccgttctcatttatttcag

SEQ ID NO: 238333 - DNA, 27 bp, Artificial sequence
  SiRNA target sequence
tatccttccgttctcatttatttcagt

SEQ ID NO: 238334 - DNA, 27 bp, Artificial sequence
  SiRNA target sequence
atccttccgttctcatttatttcagta

SEQ ID NO: 238335 - DNA, 27 bp, Artificial sequence
  SiRNA target sequence
tccttccgttctcatttatttcagtag

SEQ ID NO: 238336 - DNA, 27 bp, Artificial sequence
  SiRNA target sequence
ccttccgttctcatttatttcagtagg

SEQ ID NO: 238337 - DNA, 27 bp, Artificial sequence
  SiRNA target sequence
cttccgttctcatttatttcagtaggt

SEQ ID NO: 238338 - DNA, 27 bp, Artificial sequence
  SiRNA target sequence
ttccgttctcatttatttcagtaggta

SEQ ID NO: 238339 - DNA, 27 bp, Artificial sequence
  SiRNA target sequence
tccgttctcatttatttcagtaggtat

SEQ ID NO: 238340 - DNA, 27 bp, Artificial sequence
  SiRNA target sequence
ccgttctcatttatttcagtaggtatt

SEQ ID NO: 238341 - DNA, 27 bp, Artificial sequence
  SiRNA target sequence
cgttctcatttatttcagtaggtatta

SEQ ID NO: 238342 - DNA, 27 bp, Artificial sequence
  SiRNA target sequence
gttctcatttatttcagtaggtattat

SEQ ID NO: 238343 - DNA, 27 bp, Artificial sequence
  SiRNA target sequence
ttctcatttatttcagtaggtattatt

SEQ ID NO: 238344 - DNA, 27 bp, Artificial sequence
  SiRNA target sequence
tctcatttatttcagtaggtattattc

SEQ ID NO: 238345 - DNA, 27 bp, Artificial sequence
  SiRNA target sequence
ctcatttatttcagtaggtattattca

SEQ ID NO: 238346 - DNA, 27 bp, Artificial sequence
  SiRNA target sequence
tcatttatttcagtaggtattattcag

SEQ ID NO: 238347 - DNA, 27 bp, Artificial sequence
  SiRNA target sequence
catttatttcagtaggtattattcaga

SEQ ID NO: 238348 - DNA, 27 bp, Artificial sequence
  SiRNA target sequence
atttatttcagtaggtattattcagaa

SEQ ID NO: 238349 - DNA, 27 bp, Artificial sequence
  SiRNA target sequence
tttatttcagtaggtattattcagaaa

SEQ ID NO: 238350 - DNA, 27 bp, Artificial sequence
  SiRNA target sequence
ttatttcagtaggtattattcagaaag

SEQ ID NO: 238351 - DNA, 27 bp, Artificial sequence
  SiRNA target sequence
tatttcagtaggtattattcagaaagc

SEQ ID NO: 238352 - DNA, 27 bp, Artificial sequence
  SiRNA target sequence
atttcagtaggtattattcagaaagct

SEQ ID NO: 238353 - DNA, 27 bp, Artificial sequence
  SiRNA target sequence
tttcagtaggtattattcagaaagctt

SEQ ID NO: 238354 - DNA, 27 bp, Artificial sequence
  SiRNA target sequence
ttcagtaggtattattcagaaagcttt

SEQ ID NO: 238355 - DNA, 27 bp, Artificial sequence
  SiRNA target sequence
tcagtaggtattattcagaaagcttta

SEQ ID NO: 238356 - DNA, 27 bp, Artificial sequence
  SiRNA target sequence
cagtaggtattattcagaaagctttag

SEQ ID NO: 238357 - DNA, 27 bp, Artificial sequence
  SiRNA target sequence
agtaggtattattcagaaagctttaga

SEQ ID NO: 238358 - DNA, 27 bp, Artificial sequence
  SiRNA target sequence
gtaggtattattcagaaagctttagat

SEQ ID NO: 238359 - DNA, 27 bp, Artificial sequence
  SiRNA target sequence
taggtattattcagaaagctttagata

SEQ ID NO: 238360 - DNA, 27 bp, Artificial sequence
  SiRNA target sequence
aggtattattcagaaagctttagataa

SEQ ID NO: 238361 - DNA, 27 bp, Artificial sequence
  SiRNA target sequence
ggtattattcagaaagctttagataaa

SEQ ID NO: 238362 - DNA, 27 bp, Artificial sequence
  SiRNA target sequence
gtattattcagaaagctttagataaat

SEQ ID NO: 238363 - DNA, 27 bp, Artificial sequence
  SiRNA target sequence
tattattcagaaagctttagataaata

SEQ ID NO: 238364 - DNA, 27 bp, Artificial sequence
  SiRNA target sequence
attattcagaaagctttagataaatat

SEQ ID NO: 238365 - DNA, 27 bp, Artificial sequence
  SiRNA target sequence
ttattcagaaagctttagataaatatc

SEQ ID NO: 238366 - DNA, 27 bp, Artificial sequence
  SiRNA target sequence
tattcagaaagctttagataaatatcc

SEQ ID NO: 238367 - DNA, 27 bp, Artificial sequence
  SiRNA target sequence
attcagaaagctttagataaatatcct

SEQ ID NO: 238368 - DNA, 27 bp, Artificial sequence
  SiRNA target sequence
ttcagaaagctttagataaatatcctt

SEQ ID NO: 238369 - DNA, 27 bp, Artificial sequence
  SiRNA target sequence
tcagaaagctttagataaatatccttt

SEQ ID NO: 238370 - DNA, 27 bp, Artificial sequence
  SiRNA target sequence
cagaaagctttagataaatatcctttt

SEQ ID NO: 238371 - DNA, 27 bp, Artificial sequence
  SiRNA target sequence
agaaagctttagataaatatcctttta

SEQ ID NO: 238372 - DNA, 27 bp, Artificial sequence
  SiRNA target sequence
gaaagctttagataaatatccttttac

SEQ ID NO: 238373 - DNA, 27 bp, Artificial sequence
  SiRNA target sequence
aaagctttagataaatatccttttaca

SEQ ID NO: 238374 - DNA, 27 bp, Artificial sequence
  SiRNA target sequence
aagctttagataaatatccttttacaa

SEQ ID NO: 238375 - DNA, 27 bp, Artificial sequence
  SiRNA target sequence
agctttagataaatatccttttacaaa

SEQ ID NO: 238376 - DNA, 27 bp, Artificial sequence
  SiRNA target sequence
gctttagataaatatccttttacaaaa

SEQ ID NO: 238377 - DNA, 27 bp, Artificial sequence
  SiRNA target sequence
ctttagataaatatccttttacaaaaa

SEQ ID NO: 238378 - DNA, 27 bp, Artificial sequence
  SiRNA target sequence
tttagataaatatccttttacaaaaat

SEQ ID NO: 238379 - DNA, 27 bp, Artificial sequence
  SiRNA target sequence
ttagataaatatccttttacaaaaata

SEQ ID NO: 238380 - DNA, 27 bp, Artificial sequence
  SiRNA target sequence
tagataaatatccttttacaaaaatat

SEQ ID NO: 238381 - DNA, 27 bp, Artificial sequence
  SiRNA target sequence
agataaatatccttttacaaaaatatt

SEQ ID NO: 238382 - DNA, 27 bp, Artificial sequence
  SiRNA target sequence
gataaatatccttttacaaaaatattt

SEQ ID NO: 238383 - DNA, 27 bp, Artificial sequence
  SiRNA target sequence
ataaatatccttttacaaaaatatttg

SEQ ID NO: 238384 - DNA, 27 bp, Artificial sequence
  SiRNA target sequence
taaatatccttttacaaaaatatttga

SEQ ID NO: 238385 - DNA, 27 bp, Artificial sequence
  SiRNA target sequence
aaatatccttttacaaaaatatttgat

SEQ ID NO: 238386 - DNA, 27 bp, Artificial sequence
  SiRNA target sequence
aatatccttttacaaaaatatttgatg

SEQ ID NO: 238387 - DNA, 27 bp, Artificial sequence
  SiRNA target sequence
atatccttttacaaaaatatttgatgt

SEQ ID NO: 238388 - DNA, 27 bp, Artificial sequence
  SiRNA target sequence
tatccttttacaaaaatatttgatgta

SEQ ID NO: 238389 - DNA, 27 bp, Artificial sequence
  SiRNA target sequence
atccttttacaaaaatatttgatgtaa

SEQ ID NO: 238390 - DNA, 27 bp, Artificial sequence
  SiRNA target sequence
tccttttacaaaaatatttgatgtaac

SEQ ID NO: 238391 - DNA, 27 bp, Artificial sequence
  SiRNA target sequence
ccttttacaaaaatatttgatgtaact

SEQ ID NO: 238392 - DNA, 27 bp, Artificial sequence
  SiRNA target sequence
cttttacaaaaatatttgatgtaactt

SEQ ID NO: 238393 - DNA, 27 bp, Artificial sequence
  SiRNA target sequence
ttttacaaaaatatttgatgtaacttt

SEQ ID NO: 238394 - DNA, 27 bp, Artificial sequence
  SiRNA target sequence
tttacaaaaatatttgatgtaacttta

SEQ ID NO: 238395 - DNA, 27 bp, Artificial sequence
  SiRNA target sequence
ttacaaaaatatttgatgtaactttaa

SEQ ID NO: 238396 - DNA, 27 bp, Artificial sequence
  SiRNA target sequence
tacaaaaatatttgatgtaactttaat

SEQ ID NO: 238397 - DNA, 27 bp, Artificial sequence
  SiRNA target sequence
acaaaaatatttgatgtaactttaata

SEQ ID NO: 238398 - DNA, 27 bp, Artificial sequence
  SiRNA target sequence
caaaaatatttgatgtaactttaatag

SEQ ID NO: 238399 - DNA, 27 bp, Artificial sequence
  SiRNA target sequence
aaaaatatttgatgtaactttaatagt

SEQ ID NO: 238400 - DNA, 27 bp, Artificial sequence
  SiRNA target sequence
aaaatatttgatgtaactttaatagtt

SEQ ID NO: 238401 - DNA, 27 bp, Artificial sequence
  SiRNA target sequence
aaatatttgatgtaactttaatagttt

SEQ ID NO: 238402 - DNA, 27 bp, Artificial sequence
  SiRNA target sequence
aatatttgatgtaactttaatagtttt

SEQ ID NO: 238403 - DNA, 27 bp, Artificial sequence
  SiRNA target sequence
atatttgatgtaactttaatagttttc

SEQ ID NO: 238404 - DNA, 27 bp, Artificial sequence
  SiRNA target sequence
tatttgatgtaactttaatagttttcg

SEQ ID NO: 238405 - DNA, 27 bp, Artificial sequence
  SiRNA target sequence
atttgatgtaactttaatagttttcgc

SEQ ID NO: 238406 - DNA, 27 bp, Artificial sequence
  SiRNA target sequence
tttgatgtaactttaatagttttcgct

SEQ ID NO: 238407 - DNA, 27 bp, Artificial sequence
  SiRNA target sequence
ttgatgtaactttaatagttttcgctg

SEQ ID NO: 238408 - DNA, 27 bp, Artificial sequence
  SiRNA target sequence
tgatgtaactttaatagttttcgctgt

SEQ ID NO: 238409 - DNA, 27 bp, Artificial sequence
  SiRNA target sequence
gatgtaactttaatagttttcgctgtt

SEQ ID NO: 238410 - DNA, 27 bp, Artificial sequence
  SiRNA target sequence
atgtaactttaatagttttcgctgttg

SEQ ID NO: 238411 - DNA, 27 bp, Artificial sequence
  SiRNA target sequence
tgtaactttaatagttttcgctgttgc

SEQ ID NO: 238412 - DNA, 27 bp, Artificial sequence
  SiRNA target sequence
gtaactttaatagttttcgctgttgca

SEQ ID NO: 238413 - DNA, 27 bp, Artificial sequence
  SiRNA target sequence
taactttaatagttttcgctgttgcat

SEQ ID NO: 238414 - DNA, 27 bp, Artificial sequence
  SiRNA target sequence
aactttaatagttttcgctgttgcatt

SEQ ID NO: 238415 - DNA, 27 bp, Artificial sequence
  SiRNA target sequence
actttaatagttttcgctgttgcattt

SEQ ID NO: 238416 - DNA, 27 bp, Artificial sequence
  SiRNA target sequence
ctttaatagttttcgctgttgcattta

SEQ ID NO: 238417 - DNA, 27 bp, Artificial sequence
  SiRNA target sequence
tttaatagttttcgctgttgcatttac

SEQ ID NO: 238418 - DNA, 27 bp, Artificial sequence
  SiRNA target sequence
ttaatagttttcgctgttgcatttact

SEQ ID NO: 238419 - DNA, 27 bp, Artificial sequence
  SiRNA target sequence
taatagttttcgctgttgcatttacta

SEQ ID NO: 238420 - DNA, 27 bp, Artificial sequence
  SiRNA target sequence
aatagttttcgctgttgcatttactat

SEQ ID NO: 238421 - DNA, 27 bp, Artificial sequence
  SiRNA target sequence
atagttttcgctgttgcatttactata

SEQ ID NO: 238422 - DNA, 27 bp, Artificial sequence
  SiRNA target sequence
tagttttcgctgttgcatttactatac

SEQ ID NO: 238423 - DNA, 27 bp, Artificial sequence
  SiRNA target sequence
agttttcgctgttgcatttactatact

SEQ ID NO: 238424 - DNA, 27 bp, Artificial sequence
  SiRNA target sequence
gttttcgctgttgcatttactatactt

SEQ ID NO: 238425 - DNA, 27 bp, Artificial sequence
  SiRNA target sequence
ttttcgctgttgcatttactatacttg

SEQ ID NO: 238426 - DNA, 27 bp, Artificial sequence
  SiRNA target sequence
tttcgctgttgcatttactatacttgg

SEQ ID NO: 238427 - DNA, 27 bp, Artificial sequence
  SiRNA target sequence
ttcgctgttgcatttactatacttggt

SEQ ID NO: 238428 - DNA, 27 bp, Artificial sequence
  SiRNA target sequence
tcgctgttgcatttactatacttggta

SEQ ID NO: 238429 - DNA, 27 bp, Artificial sequence
  SiRNA target sequence
cgctgttgcatttactatacttggtag

SEQ ID NO: 238430 - DNA, 27 bp, Artificial sequence
  SiRNA target sequence
gctgttgcatttactatacttggtagt

SEQ ID NO: 238431 - DNA, 27 bp, Artificial sequence
  SiRNA target sequence
ctgttgcatttactatacttggtagtt

SEQ ID NO: 238432 - DNA, 27 bp, Artificial sequence
  SiRNA target sequence
tgttgcatttactatacttggtagttt

SEQ ID NO: 238433 - DNA, 27 bp, Artificial sequence
  SiRNA target sequence
gttgcatttactatacttggtagttta

SEQ ID NO: 238434 - DNA, 27 bp, Artificial sequence
  SiRNA target sequence
ttgcatttactatacttggtagtttat

SEQ ID NO: 238435 - DNA, 27 bp, Artificial sequence
  SiRNA target sequence
tgcatttactatacttggtagtttatt

SEQ ID NO: 238436 - DNA, 27 bp, Artificial sequence
  SiRNA target sequence
gcatttactatacttggtagtttatta

SEQ ID NO: 238437 - DNA, 27 bp, Artificial sequence
  SiRNA target sequence
catttactatacttggtagtttattac

SEQ ID NO: 238438 - DNA, 27 bp, Artificial sequence
  SiRNA target sequence
atttactatacttggtagtttattact

SEQ ID NO: 238439 - DNA, 27 bp, Artificial sequence
  SiRNA target sequence
tttactatacttggtagtttattactt

SEQ ID NO: 238440 - DNA, 27 bp, Artificial sequence
  SiRNA target sequence
ttactatacttggtagtttattacttc

SEQ ID NO: 238441 - DNA, 27 bp, Artificial sequence
  SiRNA target sequence
tactatacttggtagtttattacttcc

SEQ ID NO: 238442 - DNA, 27 bp, Artificial sequence
  SiRNA target sequence
actatacttggtagtttattacttccc

SEQ ID NO: 238443 - DNA, 27 bp, Artificial sequence
  SiRNA target sequence
ctatacttggtagtttattacttccct

SEQ ID NO: 238444 - DNA, 27 bp, Artificial sequence
  SiRNA target sequence
tatacttggtagtttattacttccctt

SEQ ID NO: 238445 - DNA, 27 bp, Artificial sequence
  SiRNA target sequence
atacttggtagtttattacttcccttt

SEQ ID NO: 238446 - DNA, 27 bp, Artificial sequence
  SiRNA target sequence
tacttggtagtttattacttcccttta

SEQ ID NO: 238447 - DNA, 27 bp, Artificial sequence
  SiRNA target sequence
acttggtagtttattacttccctttag

SEQ ID NO: 238448 - DNA, 27 bp, Artificial sequence
  SiRNA target sequence
cttggtagtttattacttccctttagt

SEQ ID NO: 238449 - DNA, 27 bp, Artificial sequence
  SiRNA target sequence
ttggtagtttattacttccctttagtg

SEQ ID NO: 238450 - DNA, 27 bp, Artificial sequence
  SiRNA target sequence
tggtagtttattacttccctttagtga

SEQ ID NO: 238451 - DNA, 27 bp, Artificial sequence
  SiRNA target sequence
ggtagtttattacttccctttagtgat

SEQ ID NO: 238452 - DNA, 27 bp, Artificial sequence
  SiRNA target sequence
gtagtttattacttccctttagtgatt

SEQ ID NO: 238453 - DNA, 27 bp, Artificial sequence
  SiRNA target sequence
tagtttattacttccctttagtgatta

SEQ ID NO: 238454 - DNA, 27 bp, Artificial sequence
  SiRNA target sequence
agtttattacttccctttagtgattat

SEQ ID NO: 238455 - DNA, 27 bp, Artificial sequence
  SiRNA target sequence
gtttattacttccctttagtgattata

SEQ ID NO: 238456 - DNA, 27 bp, Artificial sequence
  SiRNA target sequence
tttattacttccctttagtgattatat

SEQ ID NO: 238457 - DNA, 27 bp, Artificial sequence
  SiRNA target sequence
ttattacttccctttagtgattatatt

SEQ ID NO: 238458 - DNA, 27 bp, Artificial sequence
  SiRNA target sequence
tattacttccctttagtgattatattc

SEQ ID NO: 238459 - DNA, 27 bp, Artificial sequence
  SiRNA target sequence
attacttccctttagtgattatattca

SEQ ID NO: 238460 - DNA, 27 bp, Artificial sequence
  SiRNA target sequence
ttacttccctttagtgattatattcag

SEQ ID NO: 238461 - DNA, 27 bp, Artificial sequence
  SiRNA target sequence
tacttccctttagtgattatattcaga

SEQ ID NO: 238462 - DNA, 27 bp, Artificial sequence
  SiRNA target sequence
acttccctttagtgattatattcagat

SEQ ID NO: 238463 - DNA, 27 bp, Artificial sequence
  SiRNA target sequence
cttccctttagtgattatattcagatt

SEQ ID NO: 238464 - DNA, 27 bp, Artificial sequence
  SiRNA target sequence
ttccctttagtgattatattcagattc

SEQ ID NO: 238465 - DNA, 27 bp, Artificial sequence
  SiRNA target sequence
tccctttagtgattatattcagattca

SEQ ID NO: 238466 - DNA, 27 bp, Artificial sequence
  SiRNA target sequence
ccctttagtgattatattcagattcaa

SEQ ID NO: 238467 - DNA, 27 bp, Artificial sequence
  SiRNA target sequence
cctttagtgattatattcagattcaac

SEQ ID NO: 238468 - DNA, 27 bp, Artificial sequence
  SiRNA target sequence
ctttagtgattatattcagattcaacc

SEQ ID NO: 238469 - DNA, 27 bp, Artificial sequence
  SiRNA target sequence
tttagtgattatattcagattcaaccg

SEQ ID NO: 238470 - DNA, 27 bp, Artificial sequence
  SiRNA target sequence
ttagtgattatattcagattcaaccgt

SEQ ID NO: 238471 - DNA, 27 bp, Artificial sequence
  SiRNA target sequence
tagtgattatattcagattcaaccgtt

SEQ ID NO: 238472 - DNA, 27 bp, Artificial sequence
  SiRNA target sequence
agtgattatattcagattcaaccgttt

SEQ ID NO: 238473 - DNA, 27 bp, Artificial sequence
  SiRNA target sequence
gtgattatattcagattcaaccgtttt

SEQ ID NO: 238474 - DNA, 27 bp, Artificial sequence
  SiRNA target sequence
tgattatattcagattcaaccgttttg

SEQ ID NO: 238475 - DNA, 27 bp, Artificial sequence
  SiRNA target sequence
gattatattcagattcaaccgttttgg

SEQ ID NO: 238476 - DNA, 27 bp, Artificial sequence
  SiRNA target sequence
attatattcagattcaaccgttttggg

SEQ ID NO: 238477 - DNA, 27 bp, Artificial sequence
  SiRNA target sequence
ttatattcagattcaaccgttttgggc

SEQ ID NO: 238478 - DNA, 27 bp, Artificial sequence
  SiRNA target sequence
tatattcagattcaaccgttttgggcc

SEQ ID NO: 238479 - DNA, 27 bp, Artificial sequence
  SiRNA target sequence
atattcagattcaaccgttttgggcca

SEQ ID NO: 238480 - DNA, 27 bp, Artificial sequence
  SiRNA target sequence
tattcagattcaaccgttttgggccaa

SEQ ID NO: 238481 - DNA, 27 bp, Artificial sequence
  SiRNA target sequence
attcagattcaaccgttttgggccaaa

SEQ ID NO: 238482 - DNA, 27 bp, Artificial sequence
  SiRNA target sequence
ttcagattcaaccgttttgggccaaag

SEQ ID NO: 238483 - DNA, 27 bp, Artificial sequence
  SiRNA target sequence
tcagattcaaccgttttgggccaaaga

SEQ ID NO: 238484 - DNA, 27 bp, Artificial sequence
  SiRNA target sequence
cagattcaaccgttttgggccaaagat

SEQ ID NO: 238485 - DNA, 27 bp, Artificial sequence
  SiRNA target sequence
agattcaaccgttttgggccaaagata

SEQ ID NO: 238486 - DNA, 27 bp, Artificial sequence
  SiRNA target sequence
gattcaaccgttttgggccaaagatat

SEQ ID NO: 238487 - DNA, 27 bp, Artificial sequence
  SiRNA target sequence
attcaaccgttttgggccaaagatatt

SEQ ID NO: 238488 - DNA, 27 bp, Artificial sequence
  SiRNA target sequence
ttcaaccgttttgggccaaagatattt

SEQ ID NO: 238489 - DNA, 27 bp, Artificial sequence
  SiRNA target sequence
tcaaccgttttgggccaaagatatttt

SEQ ID NO: 238490 - DNA, 27 bp, Artificial sequence
  SiRNA target sequence
caaccgttttgggccaaagatattttt

SEQ ID NO: 238491 - DNA, 27 bp, Artificial sequence
  SiRNA target sequence
aaccgttttgggccaaagatatttttg

SEQ ID NO: 238492 - DNA, 27 bp, Artificial sequence
  SiRNA target sequence
accgttttgggccaaagatatttttgc

SEQ ID NO: 238493 - DNA, 27 bp, Artificial sequence
  SiRNA target sequence
ccgttttgggccaaagatatttttgct

SEQ ID NO: 238494 - DNA, 27 bp, Artificial sequence
  SiRNA target sequence
cgttttgggccaaagatatttttgctg

SEQ ID NO: 238495 - DNA, 27 bp, Artificial sequence
  SiRNA target sequence
gttttgggccaaagatatttttgctga

SEQ ID NO: 238496 - DNA, 27 bp, Artificial sequence
  SiRNA target sequence
ttttgggccaaagatatttttgctgat

SEQ ID NO: 238497 - DNA, 27 bp, Artificial sequence
  SiRNA target sequence
tttgggccaaagatatttttgctgatg

SEQ ID NO: 238498 - DNA, 27 bp, Artificial sequence
  SiRNA target sequence
ttgggccaaagatatttttgctgatgg

SEQ ID NO: 238499 - DNA, 27 bp, Artificial sequence
  SiRNA target sequence
tgggccaaagatatttttgctgatgga

SEQ ID NO: 238500 - DNA, 27 bp, Artificial sequence
  SiRNA target sequence
gggccaaagatatttttgctgatggaa

SEQ ID NO: 238501 - DNA, 27 bp, Artificial sequence
  SiRNA target sequence
ggccaaagatatttttgctgatggaaa

SEQ ID NO: 238502 - DNA, 27 bp, Artificial sequence
  SiRNA target sequence
gccaaagatatttttgctgatggaaaa

SEQ ID NO: 238503 - DNA, 27 bp, Artificial sequence
  SiRNA target sequence
ccaaagatatttttgctgatggaaaag

SEQ ID NO: 238504 - DNA, 27 bp, Artificial sequence
  SiRNA target sequence
caaagatatttttgctgatggaaaagc

SEQ ID NO: 238505 - DNA, 27 bp, Artificial sequence
  SiRNA target sequence
aaagatatttttgctgatggaaaagct

SEQ ID NO: 238506 - DNA, 27 bp, Artificial sequence
  SiRNA target sequence
aagatatttttgctgatggaaaagctg

SEQ ID NO: 238507 - DNA, 27 bp, Artificial sequence
  SiRNA target sequence
agatatttttgctgatggaaaagctgt

SEQ ID NO: 238508 - DNA, 27 bp, Artificial sequence
  SiRNA target sequence
gatatttttgctgatggaaaagctgtt

SEQ ID NO: 238509 - DNA, 27 bp, Artificial sequence
  SiRNA target sequence
atatttttgctgatggaaaagctgttg

SEQ ID NO: 238510 - DNA, 27 bp, Artificial sequence
  SiRNA target sequence
tatttttgctgatggaaaagctgttgc

SEQ ID NO: 238511 - DNA, 27 bp, Artificial sequence
  SiRNA target sequence
atttttgctgatggaaaagctgttgcc

SEQ ID NO: 238512 - DNA, 27 bp, Artificial sequence
  SiRNA target sequence
tttttgctgatggaaaagctgttgcca

SEQ ID NO: 238513 - DNA, 27 bp, Artificial sequence
  SiRNA target sequence
ttttgctgatggaaaagctgttgccag

SEQ ID NO: 238514 - DNA, 27 bp, Artificial sequence
  SiRNA target sequence
tttgctgatggaaaagctgttgccaga

SEQ ID NO: 238515 - DNA, 27 bp, Artificial sequence
  SiRNA target sequence
ttgctgatggaaaagctgttgccagaa

SEQ ID NO: 238516 - DNA, 27 bp, Artificial sequence
  SiRNA target sequence
tgctgatggaaaagctgttgccagaag

SEQ ID NO: 238517 - DNA, 27 bp, Artificial sequence
  SiRNA target sequence
gctgatggaaaagctgttgccagaagt

SEQ ID NO: 238518 - DNA, 27 bp, Artificial sequence
  SiRNA target sequence
ctgatggaaaagctgttgccagaagta

SEQ ID NO: 238519 - DNA, 27 bp, Artificial sequence
  SiRNA target sequence
tgatggaaaagctgttgccagaagtac

SEQ ID NO: 238520 - DNA, 27 bp, Artificial sequence
  SiRNA target sequence
gatggaaaagctgttgccagaagtaca

SEQ ID NO: 238521 - DNA, 27 bp, Artificial sequence
  SiRNA target sequence
atggaaaagctgttgccagaagtacag

SEQ ID NO: 238522 - DNA, 27 bp, Artificial sequence
  SiRNA target sequence
tggaaaagctgttgccagaagtacaga

SEQ ID NO: 238523 - DNA, 27 bp, Artificial sequence
  SiRNA target sequence
ggaaaagctgttgccagaagtacagat

SEQ ID NO: 238524 - DNA, 27 bp, Artificial sequence
  SiRNA target sequence
gaaaagctgttgccagaagtacagatt

SEQ ID NO: 238525 - DNA, 27 bp, Artificial sequence
  SiRNA target sequence
aaaagctgttgccagaagtacagattt

SEQ ID NO: 238526 - DNA, 27 bp, Artificial sequence
  SiRNA target sequence
aaagctgttgccagaagtacagatttt

SEQ ID NO: 238527 - DNA, 27 bp, Artificial sequence
  SiRNA target sequence
aagctgttgccagaagtacagattttt

SEQ ID NO: 238528 - DNA, 27 bp, Artificial sequence
  SiRNA target sequence
agctgttgccagaagtacagatttttt

SEQ ID NO: 238529 - DNA, 27 bp, Artificial sequence
  SiRNA target sequence
gctgttgccagaagtacagatttttta

SEQ ID NO: 238530 - DNA, 27 bp, Artificial sequence
  SiRNA target sequence
ctgttgccagaagtacagattttttat

SEQ ID NO: 238531 - DNA, 27 bp, Artificial sequence
  SiRNA target sequence
tgttgccagaagtacagattttttatt

SEQ ID NO: 238532 - DNA, 27 bp, Artificial sequence
  SiRNA target sequence
gttgccagaagtacagattttttattt

SEQ ID NO: 238533 - DNA, 27 bp, Artificial sequence
  SiRNA target sequence
ttgccagaagtacagattttttatttt

SEQ ID NO: 238534 - DNA, 27 bp, Artificial sequence
  SiRNA target sequence
tgccagaagtacagattttttattttc

SEQ ID NO: 238535 - DNA, 27 bp, Artificial sequence
  SiRNA target sequence
gccagaagtacagattttttattttct

SEQ ID NO: 238536 - DNA, 27 bp, Artificial sequence
  SiRNA target sequence
ccagaagtacagattttttattttcta

SEQ ID NO: 238537 - DNA, 27 bp, Artificial sequence
  SiRNA target sequence
cagaagtacagattttttattttctat

SEQ ID NO: 238538 - DNA, 27 bp, Artificial sequence
  SiRNA target sequence
agaagtacagattttttattttctatt

SEQ ID NO: 238539 - DNA, 27 bp, Artificial sequence
  SiRNA target sequence
gaagtacagattttttattttctattg

SEQ ID NO: 238540 - DNA, 27 bp, Artificial sequence
  SiRNA target sequence
aagtacagattttttattttctattgc

SEQ ID NO: 238541 - DNA, 27 bp, Artificial sequence
  SiRNA target sequence
agtacagattttttattttctattgca

SEQ ID NO: 238542 - DNA, 27 bp, Artificial sequence
  SiRNA target sequence
gtacagattttttattttctattgcac

SEQ ID NO: 238543 - DNA, 27 bp, Artificial sequence
  SiRNA target sequence
tacagattttttattttctattgcact

SEQ ID NO: 238544 - DNA, 27 bp, Artificial sequence
  SiRNA target sequence
acagattttttattttctattgcactt

SEQ ID NO: 238545 - DNA, 27 bp, Artificial sequence
  SiRNA target sequence
cagattttttattttctattgcacttg

SEQ ID NO: 238546 - DNA, 27 bp, Artificial sequence
  SiRNA target sequence
agattttttattttctattgcacttgt

SEQ ID NO: 238547 - DNA, 27 bp, Artificial sequence
  SiRNA target sequence
gattttttattttctattgcacttgtt

SEQ ID NO: 238548 - DNA, 27 bp, Artificial sequence
  SiRNA target sequence
attttttattttctattgcacttgttt

SEQ ID NO: 238549 - DNA, 27 bp, Artificial sequence
  SiRNA target sequence
ttttttattttctattgcacttgtttt

SEQ ID NO: 238550 - DNA, 27 bp, Artificial sequence
  SiRNA target sequence
tttttattttctattgcacttgttttc

SEQ ID NO: 238551 - DNA, 27 bp, Artificial sequence
  SiRNA target sequence
ttttattttctattgcacttgttttca

SEQ ID NO: 238552 - DNA, 27 bp, Artificial sequence
  SiRNA target sequence
tttattttctattgcacttgttttcaa

SEQ ID NO: 238553 - DNA, 27 bp, Artificial sequence
  SiRNA target sequence
ttattttctattgcacttgttttcaat

SEQ ID NO: 238554 - DNA, 27 bp, Artificial sequence
  SiRNA target sequence
tattttctattgcacttgttttcaatg

SEQ ID NO: 238555 - DNA, 27 bp, Artificial sequence
  SiRNA target sequence
attttctattgcacttgttttcaatga

SEQ ID NO: 238556 - DNA, 27 bp, Artificial sequence
  SiRNA target sequence
ttttctattgcacttgttttcaatgaa

SEQ ID NO: 238557 - DNA, 27 bp, Artificial sequence
  SiRNA target sequence
tttctattgcacttgttttcaatgaat

SEQ ID NO: 238558 - DNA, 27 bp, Artificial sequence
  SiRNA target sequence
ttctattgcacttgttttcaatgaatg

SEQ ID NO: 238559 - DNA, 27 bp, Artificial sequence
  SiRNA target sequence
tctattgcacttgttttcaatgaatgg

SEQ ID NO: 238560 - DNA, 27 bp, Artificial sequence
  SiRNA target sequence
ctattgcacttgttttcaatgaatgga

SEQ ID NO: 238561 - DNA, 27 bp, Artificial sequence
  SiRNA target sequence
tattgcacttgttttcaatgaatggac

SEQ ID NO: 238562 - DNA, 27 bp, Artificial sequence
  SiRNA target sequence
attgcacttgttttcaatgaatggaca

SEQ ID NO: 238563 - DNA, 27 bp, Artificial sequence
  SiRNA target sequence
ttgcacttgttttcaatgaatggacaa

SEQ ID NO: 238564 - DNA, 27 bp, Artificial sequence
  SiRNA target sequence
tgcacttgttttcaatgaatggacaag

SEQ ID NO: 238565 - DNA, 27 bp, Artificial sequence
  SiRNA target sequence
gcacttgttttcaatgaatggacaagt

SEQ ID NO: 238566 - DNA, 27 bp, Artificial sequence
  SiRNA target sequence
cacttgttttcaatgaatggacaagtt

SEQ ID NO: 238567 - DNA, 27 bp, Artificial sequence
  SiRNA target sequence
acttgttttcaatgaatggacaagttc

SEQ ID NO: 238568 - DNA, 27 bp, Artificial sequence
  SiRNA target sequence
cttgttttcaatgaatggacaagttct

SEQ ID NO: 238569 - DNA, 27 bp, Artificial sequence
  SiRNA target sequence
ttgttttcaatgaatggacaagttctg

SEQ ID NO: 238570 - DNA, 27 bp, Artificial sequence
  SiRNA target sequence
tgttttcaatgaatggacaagttctgc

SEQ ID NO: 238571 - DNA, 27 bp, Artificial sequence
  SiRNA target sequence
gttttcaatgaatggacaagttctgct

SEQ ID NO: 238572 - DNA, 27 bp, Artificial sequence
  SiRNA target sequence
ttttcaatgaatggacaagttctgcta

SEQ ID NO: 238573 - DNA, 27 bp, Artificial sequence
  SiRNA target sequence
tttcaatgaatggacaagttctgctat

SEQ ID NO: 238574 - DNA, 27 bp, Artificial sequence
  SiRNA target sequence
ttcaatgaatggacaagttctgctatc

SEQ ID NO: 238575 - DNA, 27 bp, Artificial sequence
  SiRNA target sequence
tcaatgaatggacaagttctgctatct

SEQ ID NO: 238576 - DNA, 27 bp, Artificial sequence
  SiRNA target sequence
caatgaatggacaagttctgctatcta

SEQ ID NO: 238577 - DNA, 27 bp, Artificial sequence
  SiRNA target sequence
aatgaatggacaagttctgctatctat

SEQ ID NO: 238578 - DNA, 27 bp, Artificial sequence
  SiRNA target sequence
atgaatggacaagttctgctatctatg

SEQ ID NO: 238579 - DNA, 27 bp, Artificial sequence
  SiRNA target sequence
tgaatggacaagttctgctatctatgt

SEQ ID NO: 238580 - DNA, 27 bp, Artificial sequence
  SiRNA target sequence
gaatggacaagttctgctatctatgtt

SEQ ID NO: 238581 - DNA, 27 bp, Artificial sequence
  SiRNA target sequence
aatggacaagttctgctatctatgttt

SEQ ID NO: 238582 - DNA, 27 bp, Artificial sequence
  SiRNA target sequence
atggacaagttctgctatctatgtttt

SEQ ID NO: 238583 - DNA, 27 bp, Artificial sequence
  SiRNA target sequence
tggacaagttctgctatctatgtttta

SEQ ID NO: 238584 - DNA, 27 bp, Artificial sequence
  SiRNA target sequence
ggacaagttctgctatctatgttttat

SEQ ID NO: 238585 - DNA, 27 bp, Artificial sequence
  SiRNA target sequence
gacaagttctgctatctatgttttatc

SEQ ID NO: 238586 - DNA, 27 bp, Artificial sequence
  SiRNA target sequence
acaagttctgctatctatgttttatct

SEQ ID NO: 238587 - DNA, 27 bp, Artificial sequence
  SiRNA target sequence
caagttctgctatctatgttttatctg

SEQ ID NO: 238588 - DNA, 27 bp, Artificial sequence
  SiRNA target sequence
aagttctgctatctatgttttatctga

SEQ ID NO: 238589 - DNA, 27 bp, Artificial sequence
  SiRNA target sequence
agttctgctatctatgttttatctgaa

SEQ ID NO: 238590 - DNA, 27 bp, Artificial sequence
  SiRNA target sequence
gttctgctatctatgttttatctgaaa

SEQ ID NO: 238591 - DNA, 27 bp, Artificial sequence
  SiRNA target sequence
ttctgctatctatgttttatctgaaat

SEQ ID NO: 238592 - DNA, 27 bp, Artificial sequence
  SiRNA target sequence
tctgctatctatgttttatctgaaatg

SEQ ID NO: 238593 - DNA, 27 bp, Artificial sequence
  SiRNA target sequence
ctgctatctatgttttatctgaaatgt

SEQ ID NO: 238594 - DNA, 27 bp, Artificial sequence
  SiRNA target sequence
tgctatctatgttttatctgaaatgtt

SEQ ID NO: 238595 - DNA, 27 bp, Artificial sequence
  SiRNA target sequence
gctatctatgttttatctgaaatgttt

SEQ ID NO: 238596 - DNA, 27 bp, Artificial sequence
  SiRNA target sequence
ctatctatgttttatctgaaatgtttg

SEQ ID NO: 238597 - DNA, 27 bp, Artificial sequence
  SiRNA target sequence
tatctatgttttatctgaaatgtttgg

SEQ ID NO: 238598 - DNA, 27 bp, Artificial sequence
  SiRNA target sequence
atctatgttttatctgaaatgtttggt

SEQ ID NO: 238599 - DNA, 27 bp, Artificial sequence
  SiRNA target sequence
tctatgttttatctgaaatgtttggta

SEQ ID NO: 238600 - DNA, 27 bp, Artificial sequence
  SiRNA target sequence
ctatgttttatctgaaatgtttggtag

SEQ ID NO: 238601 - DNA, 27 bp, Artificial sequence
  SiRNA target sequence
tatgttttatctgaaatgtttggtagt

SEQ ID NO: 238602 - DNA, 27 bp, Artificial sequence
  SiRNA target sequence
atgttttatctgaaatgtttggtagtt

SEQ ID NO: 238603 - DNA, 27 bp, Artificial sequence
  SiRNA target sequence
tgttttatctgaaatgtttggtagttt

SEQ ID NO: 238604 - DNA, 27 bp, Artificial sequence
  SiRNA target sequence
gttttatctgaaatgtttggtagtttg

SEQ ID NO: 238605 - DNA, 27 bp, Artificial sequence
  SiRNA target sequence
ttttatctgaaatgtttggtagtttga

SEQ ID NO: 238606 - DNA, 27 bp, Artificial sequence
  SiRNA target sequence
tttatctgaaatgtttggtagtttgat

SEQ ID NO: 238607 - DNA, 27 bp, Artificial sequence
  SiRNA target sequence
ttatctgaaatgtttggtagtttgatt

SEQ ID NO: 238608 - DNA, 27 bp, Artificial sequence
  SiRNA target sequence
tatctgaaatgtttggtagtttgattc

SEQ ID NO: 238609 - DNA, 27 bp, Artificial sequence
  SiRNA target sequence
atctgaaatgtttggtagtttgattct

SEQ ID NO: 238610 - DNA, 27 bp, Artificial sequence
  SiRNA target sequence
tctgaaatgtttggtagtttgattctt

SEQ ID NO: 238611 - DNA, 27 bp, Artificial sequence
  SiRNA target sequence
ctgaaatgtttggtagtttgattcttt

SEQ ID NO: 238612 - DNA, 27 bp, Artificial sequence
  SiRNA target sequence
tgaaatgtttggtagtttgattctttc

SEQ ID NO: 238613 - DNA, 27 bp, Artificial sequence
  SiRNA target sequence
gaaatgtttggtagtttgattctttca

SEQ ID NO: 238614 - DNA, 27 bp, Artificial sequence
  SiRNA target sequence
aaatgtttggtagtttgattctttcat

SEQ ID NO: 238615 - DNA, 27 bp, Artificial sequence
  SiRNA target sequence
aatgtttggtagtttgattctttcata

SEQ ID NO: 238616 - DNA, 27 bp, Artificial sequence
  SiRNA target sequence
atgtttggtagtttgattctttcatat

SEQ ID NO: 238617 - DNA, 27 bp, Artificial sequence
  SiRNA target sequence
tgtttggtagtttgattctttcatatt

SEQ ID NO: 238618 - DNA, 27 bp, Artificial sequence
  SiRNA target sequence
gtttggtagtttgattctttcatattt

SEQ ID NO: 238619 - DNA, 27 bp, Artificial sequence
  SiRNA target sequence
tttggtagtttgattctttcatattta

SEQ ID NO: 238620 - DNA, 27 bp, Artificial sequence
  SiRNA target sequence
ttggtagtttgattctttcatatttat

SEQ ID NO: 238621 - DNA, 27 bp, Artificial sequence
  SiRNA target sequence
tggtagtttgattctttcatatttatt

SEQ ID NO: 238622 - DNA, 27 bp, Artificial sequence
  SiRNA target sequence
ggtagtttgattctttcatatttattt

SEQ ID NO: 238623 - DNA, 27 bp, Artificial sequence
  SiRNA target sequence
gtagtttgattctttcatatttattta

SEQ ID NO: 238624 - DNA, 27 bp, Artificial sequence
  SiRNA target sequence
tagtttgattctttcatatttatttat

SEQ ID NO: 238625 - DNA, 27 bp, Artificial sequence
  SiRNA target sequence
agtttgattctttcatatttatttatg

SEQ ID NO: 238626 - DNA, 27 bp, Artificial sequence
  SiRNA target sequence
gtttgattctttcatatttatttatga

SEQ ID NO: 238627 - DNA, 27 bp, Artificial sequence
  SiRNA target sequence
tttgattctttcatatttatttatgac

SEQ ID NO: 238628 - DNA, 27 bp, Artificial sequence
  SiRNA target sequence
ttgattctttcatatttatttatgacg

SEQ ID NO: 238629 - DNA, 27 bp, Artificial sequence
  SiRNA target sequence
tgattctttcatatttatttatgacgt

SEQ ID NO: 238630 - DNA, 27 bp, Artificial sequence
  SiRNA target sequence
gattctttcatatttatttatgacgtt

SEQ ID NO: 238631 - DNA, 27 bp, Artificial sequence
  SiRNA target sequence
attctttcatatttatttatgacgttt

SEQ ID NO: 238632 - DNA, 27 bp, Artificial sequence
  SiRNA target sequence
ttctttcatatttatttatgacgtttg

SEQ ID NO: 238633 - DNA, 27 bp, Artificial sequence
  SiRNA target sequence
tctttcatatttatttatgacgtttgc

SEQ ID NO: 238634 - DNA, 27 bp, Artificial sequence
  SiRNA target sequence
ctttcatatttatttatgacgtttgct

SEQ ID NO: 238635 - DNA, 27 bp, Artificial sequence
  SiRNA target sequence
tttcatatttatttatgacgtttgcta

SEQ ID NO: 238636 - DNA, 27 bp, Artificial sequence
  SiRNA target sequence
ttcatatttatttatgacgtttgctaa

SEQ ID NO: 238637 - DNA, 27 bp, Artificial sequence
  SiRNA target sequence
tcatatttatttatgacgtttgctaat

SEQ ID NO: 238638 - DNA, 27 bp, Artificial sequence
  SiRNA target sequence
catatttatttatgacgtttgctaatg

SEQ ID NO: 238639 - DNA, 27 bp, Artificial sequence
  SiRNA target sequence
atatttatttatgacgtttgctaatgg

SEQ ID NO: 238640 - DNA, 27 bp, Artificial sequence
  SiRNA target sequence
tatttatttatgacgtttgctaatggt

SEQ ID NO: 238641 - DNA, 27 bp, Artificial sequence
  SiRNA target sequence
atttatttatgacgtttgctaatggtc

SEQ ID NO: 238642 - DNA, 27 bp, Artificial sequence
  SiRNA target sequence
tttatttatgacgtttgctaatggtct

SEQ ID NO: 238643 - DNA, 27 bp, Artificial sequence
  SiRNA target sequence
ttatttatgacgtttgctaatggtctt

SEQ ID NO: 238644 - DNA, 27 bp, Artificial sequence
  SiRNA target sequence
tatttatgacgtttgctaatggtcttt

SEQ ID NO: 238645 - DNA, 27 bp, Artificial sequence
  SiRNA target sequence
atttatgacgtttgctaatggtctttc

SEQ ID NO: 238646 - DNA, 27 bp, Artificial sequence
  SiRNA target sequence
tttatgacgtttgctaatggtctttcg

SEQ ID NO: 238647 - DNA, 27 bp, Artificial sequence
  SiRNA target sequence
ttatgacgtttgctaatggtctttcga

SEQ ID NO: 238648 - DNA, 27 bp, Artificial sequence
  SiRNA target sequence
tatgacgtttgctaatggtctttcgac

SEQ ID NO: 238649 - DNA, 27 bp, Artificial sequence
  SiRNA target sequence
atgacgtttgctaatggtctttcgact

SEQ ID NO: 238650 - DNA, 27 bp, Artificial sequence
  SiRNA target sequence
tgacgtttgctaatggtctttcgactc

SEQ ID NO: 238651 - DNA, 27 bp, Artificial sequence
  SiRNA target sequence
gacgtttgctaatggtctttcgactcc

SEQ ID NO: 238652 - DNA, 27 bp, Artificial sequence
  SiRNA target sequence
acgtttgctaatggtctttcgactcct

SEQ ID NO: 238653 - DNA, 27 bp, Artificial sequence
  SiRNA target sequence
cgtttgctaatggtctttcgactcctg

SEQ ID NO: 238654 - DNA, 27 bp, Artificial sequence
  SiRNA target sequence
gtttgctaatggtctttcgactcctgg

SEQ ID NO: 238655 - DNA, 27 bp, Artificial sequence
  SiRNA target sequence
tttgctaatggtctttcgactcctgga

SEQ ID NO: 238656 - DNA, 27 bp, Artificial sequence
  SiRNA target sequence
ttgctaatggtctttcgactcctggac

SEQ ID NO: 238657 - DNA, 27 bp, Artificial sequence
  SiRNA target sequence
tgctaatggtctttcgactcctggaca

SEQ ID NO: 238658 - DNA, 27 bp, Artificial sequence
  SiRNA target sequence
gctaatggtctttcgactcctggacag

SEQ ID NO: 238659 - DNA, 27 bp, Artificial sequence
  SiRNA target sequence
ctaatggtctttcgactcctggacagt

SEQ ID NO: 238660 - DNA, 27 bp, Artificial sequence
  SiRNA target sequence
taatggtctttcgactcctggacagtc

SEQ ID NO: 238661 - DNA, 27 bp, Artificial sequence
  SiRNA target sequence
aatggtctttcgactcctggacagtcc

SEQ ID NO: 238662 - DNA, 27 bp, Artificial sequence
  SiRNA target sequence
atggtctttcgactcctggacagtccg

SEQ ID NO: 238663 - DNA, 27 bp, Artificial sequence
  SiRNA target sequence
tggtctttcgactcctggacagtccgc

SEQ ID NO: 238664 - DNA, 27 bp, Artificial sequence
  SiRNA target sequence
ggtctttcgactcctggacagtccgct

SEQ ID NO: 238665 - DNA, 27 bp, Artificial sequence
  SiRNA target sequence
gtctttcgactcctggacagtccgcta

SEQ ID NO: 238666 - DNA, 27 bp, Artificial sequence
  SiRNA target sequence
tctttcgactcctggacagtccgctag

SEQ ID NO: 238667 - DNA, 27 bp, Artificial sequence
  SiRNA target sequence
ctttcgactcctggacagtccgctaga

SEQ ID NO: 238668 - DNA, 27 bp, Artificial sequence
  SiRNA target sequence
tttcgactcctggacagtccgctagat

SEQ ID NO: 238669 - DNA, 27 bp, Artificial sequence
  SiRNA target sequence
ttcgactcctggacagtccgctagatt

SEQ ID NO: 238670 - DNA, 27 bp, Artificial sequence
  SiRNA target sequence
tcgactcctggacagtccgctagattt

SEQ ID NO: 238671 - DNA, 27 bp, Artificial sequence
  SiRNA target sequence
cgactcctggacagtccgctagatttg

SEQ ID NO: 238672 - DNA, 27 bp, Artificial sequence
  SiRNA target sequence
gactcctggacagtccgctagatttgt

SEQ ID NO: 238673 - DNA, 27 bp, Artificial sequence
  SiRNA target sequence
actcctggacagtccgctagatttgtc

SEQ ID NO: 238674 - DNA, 27 bp, Artificial sequence
  SiRNA target sequence
ctcctggacagtccgctagatttgtcc

SEQ ID NO: 238675 - DNA, 27 bp, Artificial sequence
  SiRNA target sequence
tcctggacagtccgctagatttgtccc

SEQ ID NO: 238676 - DNA, 27 bp, Artificial sequence
  SiRNA target sequence
cctggacagtccgctagatttgtccct

SEQ ID NO: 238677 - DNA, 27 bp, Artificial sequence
  SiRNA target sequence
ctggacagtccgctagatttgtccctt

SEQ ID NO: 238678 - DNA, 27 bp, Artificial sequence
  SiRNA target sequence
tggacagtccgctagatttgtcccttt

SEQ ID NO: 238679 - DNA, 27 bp, Artificial sequence
  SiRNA target sequence
ggacagtccgctagatttgtcccttta

SEQ ID NO: 238680 - DNA, 27 bp, Artificial sequence
  SiRNA target sequence
gacagtccgctagatttgtccctttat

SEQ ID NO: 238681 - DNA, 27 bp, Artificial sequence
  SiRNA target sequence
acagtccgctagatttgtccctttatt

SEQ ID NO: 238682 - DNA, 27 bp, Artificial sequence
  SiRNA target sequence
cagtccgctagatttgtccctttattt

SEQ ID NO: 238683 - DNA, 27 bp, Artificial sequence
  SiRNA target sequence
agtccgctagatttgtccctttatttt

SEQ ID NO: 238684 - DNA, 27 bp, Artificial sequence
  SiRNA target sequence
gtccgctagatttgtccctttatttta

SEQ ID NO: 238685 - DNA, 27 bp, Artificial sequence
  SiRNA target sequence
tccgctagatttgtccctttattttat

SEQ ID NO: 238686 - DNA, 27 bp, Artificial sequence
  SiRNA target sequence
ccgctagatttgtccctttattttatg

SEQ ID NO: 238687 - DNA, 27 bp, Artificial sequence
  SiRNA target sequence
cgctagatttgtccctttattttatgt

SEQ ID NO: 238688 - DNA, 27 bp, Artificial sequence
  SiRNA target sequence
gctagatttgtccctttattttatgtt

SEQ ID NO: 238689 - DNA, 27 bp, Artificial sequence
  SiRNA target sequence
ctagatttgtccctttattttatgttg

SEQ ID NO: 238690 - DNA, 27 bp, Artificial sequence
  SiRNA target sequence
tagatttgtccctttattttatgttgg

SEQ ID NO: 238691 - DNA, 27 bp, Artificial sequence
  SiRNA target sequence
agatttgtccctttattttatgttgga

SEQ ID NO: 238692 - DNA, 27 bp, Artificial sequence
  SiRNA target sequence
gatttgtccctttattttatgttggat

SEQ ID NO: 238693 - DNA, 27 bp, Artificial sequence
  SiRNA target sequence
atttgtccctttattttatgttggatc

SEQ ID NO: 238694 - DNA, 27 bp, Artificial sequence
  SiRNA target sequence
tttgtccctttattttatgttggatct

SEQ ID NO: 238695 - DNA, 27 bp, Artificial sequence
  SiRNA target sequence
ttgtccctttattttatgttggatcta

SEQ ID NO: 238696 - DNA, 27 bp, Artificial sequence
  SiRNA target sequence
tgtccctttattttatgttggatctaa

SEQ ID NO: 238697 - DNA, 27 bp, Artificial sequence
  SiRNA target sequence
gtccctttattttatgttggatctaat

SEQ ID NO: 238698 - DNA, 27 bp, Artificial sequence
  SiRNA target sequence
tccctttattttatgttggatctaatt

SEQ ID NO: 238699 - DNA, 27 bp, Artificial sequence
  SiRNA target sequence
ccctttattttatgttggatctaattt

SEQ ID NO: 238700 - DNA, 27 bp, Artificial sequence
  SiRNA target sequence
cctttattttatgttggatctaatttg

SEQ ID NO: 238701 - DNA, 27 bp, Artificial sequence
  SiRNA target sequence
ctttattttatgttggatctaatttgg

SEQ ID NO: 238702 - DNA, 27 bp, Artificial sequence
  SiRNA target sequence
tttattttatgttggatctaatttggc

SEQ ID NO: 238703 - DNA, 27 bp, Artificial sequence
  SiRNA target sequence
ttattttatgttggatctaatttggct

SEQ ID NO: 238704 - DNA, 27 bp, Artificial sequence
  SiRNA target sequence
tattttatgttggatctaatttggctt

SEQ ID NO: 238705 - DNA, 27 bp, Artificial sequence
  SiRNA target sequence
attttatgttggatctaatttggcttt

SEQ ID NO: 238706 - DNA, 27 bp, Artificial sequence
  SiRNA target sequence
ttttatgttggatctaatttggcttta

SEQ ID NO: 238707 - DNA, 27 bp, Artificial sequence
  SiRNA target sequence
tttatgttggatctaatttggctttac

SEQ ID NO: 238708 - DNA, 27 bp, Artificial sequence
  SiRNA target sequence
ttatgttggatctaatttggctttact

SEQ ID NO: 238709 - DNA, 27 bp, Artificial sequence
  SiRNA target sequence
tatgttggatctaatttggctttactt

SEQ ID NO: 238710 - DNA, 27 bp, Artificial sequence
  SiRNA target sequence
atgttggatctaatttggctttacttc

SEQ ID NO: 238711 - DNA, 27 bp, Artificial sequence
  SiRNA target sequence
tgttggatctaatttggctttacttct

SEQ ID NO: 238712 - DNA, 27 bp, Artificial sequence
  SiRNA target sequence
gttggatctaatttggctttacttctt

SEQ ID NO: 238713 - DNA, 27 bp, Artificial sequence
  SiRNA target sequence
ttggatctaatttggctttacttcttt

SEQ ID NO: 238714 - DNA, 27 bp, Artificial sequence
  SiRNA target sequence
tggatctaatttggctttacttctttc

SEQ ID NO: 238715 - DNA, 27 bp, Artificial sequence
  SiRNA target sequence
ggatctaatttggctttacttctttca

SEQ ID NO: 238716 - DNA, 27 bp, Artificial sequence
  SiRNA target sequence
gatctaatttggctttacttctttcag

SEQ ID NO: 238717 - DNA, 27 bp, Artificial sequence
  SiRNA target sequence
atctaatttggctttacttctttcagg

SEQ ID NO: 238718 - DNA, 27 bp, Artificial sequence
  SiRNA target sequence
tctaatttggctttacttctttcagga

SEQ ID NO: 238719 - DNA, 27 bp, Artificial sequence
  SiRNA target sequence
ctaatttggctttacttctttcaggaa

SEQ ID NO: 238720 - DNA, 27 bp, Artificial sequence
  SiRNA target sequence
taatttggctttacttctttcaggaat

SEQ ID NO: 238721 - DNA, 27 bp, Artificial sequence
  SiRNA target sequence
aatttggctttacttctttcaggaatg

SEQ ID NO: 238722 - DNA, 27 bp, Artificial sequence
  SiRNA target sequence
atttggctttacttctttcaggaatga

SEQ ID NO: 238723 - DNA, 27 bp, Artificial sequence
  SiRNA target sequence
tttggctttacttctttcaggaatgat

SEQ ID NO: 238724 - DNA, 27 bp, Artificial sequence
  SiRNA target sequence
ttggctttacttctttcaggaatgata

SEQ ID NO: 238725 - DNA, 27 bp, Artificial sequence
  SiRNA target sequence
tggctttacttctttcaggaatgataa

SEQ ID NO: 238726 - DNA, 27 bp, Artificial sequence
  SiRNA target sequence
ggctttacttctttcaggaatgataaa

SEQ ID NO: 238727 - DNA, 27 bp, Artificial sequence
  SiRNA target sequence
gctttacttctttcaggaatgataaat

SEQ ID NO: 238728 - DNA, 27 bp, Artificial sequence
  SiRNA target sequence
ctttacttctttcaggaatgataaatt

SEQ ID NO: 238729 - DNA, 27 bp, Artificial sequence
  SiRNA target sequence
tttacttctttcaggaatgataaatta

SEQ ID NO: 238730 - DNA, 27 bp, Artificial sequence
  SiRNA target sequence
ttacttctttcaggaatgataaattac

SEQ ID NO: 238731 - DNA, 27 bp, Artificial sequence
  SiRNA target sequence
tacttctttcaggaatgataaattact

SEQ ID NO: 238732 - DNA, 27 bp, Artificial sequence
  SiRNA target sequence
acttctttcaggaatgataaattactt

SEQ ID NO: 238733 - DNA, 27 bp, Artificial sequence
  SiRNA target sequence
cttctttcaggaatgataaattacttt

SEQ ID NO: 238734 - DNA, 27 bp, Artificial sequence
  SiRNA target sequence
ttctttcaggaatgataaattactttt

SEQ ID NO: 238735 - DNA, 27 bp, Artificial sequence
  SiRNA target sequence
tctttcaggaatgataaattactttta

SEQ ID NO: 238736 - DNA, 27 bp, Artificial sequence
  SiRNA target sequence
ctttcaggaatgataaattacttttat

SEQ ID NO: 238737 - DNA, 27 bp, Artificial sequence
  SiRNA target sequence
tttcaggaatgataaattacttttata

SEQ ID NO: 238738 - DNA, 27 bp, Artificial sequence
  SiRNA target sequence
ttcaggaatgataaattacttttatag

SEQ ID NO: 238739 - DNA, 27 bp, Artificial sequence
  SiRNA target sequence
tcaggaatgataaattacttttatagt

SEQ ID NO: 238740 - DNA, 27 bp, Artificial sequence
  SiRNA target sequence
caggaatgataaattacttttatagtg

SEQ ID NO: 238741 - DNA, 27 bp, Artificial sequence
  SiRNA target sequence
aggaatgataaattacttttatagtgt

SEQ ID NO: 238742 - DNA, 27 bp, Artificial sequence
  SiRNA target sequence
ggaatgataaattacttttatagtgta

SEQ ID NO: 238743 - DNA, 27 bp, Artificial sequence
  SiRNA target sequence
gaatgataaattacttttatagtgtaa

SEQ ID NO: 238744 - DNA, 27 bp, Artificial sequence
  SiRNA target sequence
aatgataaattacttttatagtgtaag

SEQ ID NO: 238745 - DNA, 27 bp, Artificial sequence
  SiRNA target sequence
atgataaattacttttatagtgtaagt

SEQ ID NO: 238746 - DNA, 27 bp, Artificial sequence
  SiRNA target sequence
tgataaattacttttatagtgtaagta

SEQ ID NO: 238747 - DNA, 27 bp, Artificial sequence
  SiRNA target sequence
gataaattacttttatagtgtaagtaa

SEQ ID NO: 238748 - DNA, 27 bp, Artificial sequence
  SiRNA target sequence
ataaattacttttatagtgtaagtaaa

SEQ ID NO: 238749 - DNA, 27 bp, Artificial sequence
  SiRNA target sequence
taaattacttttatagtgtaagtaaat

SEQ ID NO: 238750 - DNA, 27 bp, Artificial sequence
  SiRNA target sequence
aaattacttttatagtgtaagtaaatc

SEQ ID NO: 238751 - DNA, 27 bp, Artificial sequence
  SiRNA target sequence
aattacttttatagtgtaagtaaatct

SEQ ID NO: 238752 - DNA, 27 bp, Artificial sequence
  SiRNA target sequence
attacttttatagtgtaagtaaatcta

SEQ ID NO: 238753 - DNA, 27 bp, Artificial sequence
  SiRNA target sequence
ttacttttatagtgtaagtaaatctaa

SEQ ID NO: 238754 - DNA, 27 bp, Artificial sequence
  SiRNA target sequence
tacttttatagtgtaagtaaatctaaa

SEQ ID NO: 238755 - DNA, 27 bp, Artificial sequence
  SiRNA target sequence
acttttatagtgtaagtaaatctaaaa

SEQ ID NO: 238756 - DNA, 27 bp, Artificial sequence
  SiRNA target sequence
cttttatagtgtaagtaaatctaaaat

SEQ ID NO: 238757 - DNA, 27 bp, Artificial sequence
  SiRNA target sequence
ttttatagtgtaagtaaatctaaaatg

SEQ ID NO: 238758 - DNA, 27 bp, Artificial sequence
  SiRNA target sequence
tttatagtgtaagtaaatctaaaatgt

SEQ ID NO: 238759 - DNA, 27 bp, Artificial sequence
  SiRNA target sequence
ttatagtgtaagtaaatctaaaatgtc

SEQ ID NO: 238760 - DNA, 27 bp, Artificial sequence
  SiRNA target sequence
tatagtgtaagtaaatctaaaatgtcg

SEQ ID NO: 238761 - DNA, 27 bp, Artificial sequence
  SiRNA target sequence
atagtgtaagtaaatctaaaatgtcgt

SEQ ID NO: 238762 - DNA, 27 bp, Artificial sequence
  SiRNA target sequence
tagtgtaagtaaatctaaaatgtcgta

SEQ ID NO: 238763 - DNA, 27 bp, Artificial sequence
  SiRNA target sequence
agtgtaagtaaatctaaaatgtcgtat

SEQ ID NO: 238764 - DNA, 27 bp, Artificial sequence
  SiRNA target sequence
gtgtaagtaaatctaaaatgtcgtatg

SEQ ID NO: 238765 - DNA, 27 bp, Artificial sequence
  SiRNA target sequence
tgtaagtaaatctaaaatgtcgtatgt

SEQ ID NO: 238766 - DNA, 27 bp, Artificial sequence
  SiRNA target sequence
gtaagtaaatctaaaatgtcgtatgtt

SEQ ID NO: 238767 - DNA, 27 bp, Artificial sequence
  SiRNA target sequence
taagtaaatctaaaatgtcgtatgttg

SEQ ID NO: 238768 - DNA, 27 bp, Artificial sequence
  SiRNA target sequence
aagtaaatctaaaatgtcgtatgttgc

SEQ ID NO: 238769 - DNA, 27 bp, Artificial sequence
  SiRNA target sequence
agtaaatctaaaatgtcgtatgttgcg

SEQ ID NO: 238770 - DNA, 27 bp, Artificial sequence
  SiRNA target sequence
gtaaatctaaaatgtcgtatgttgcgg

SEQ ID NO: 238771 - DNA, 27 bp, Artificial sequence
  SiRNA target sequence
taaatctaaaatgtcgtatgttgcggc

SEQ ID NO: 238772 - DNA, 27 bp, Artificial sequence
  SiRNA target sequence
aaatctaaaatgtcgtatgttgcggcc

SEQ ID NO: 238773 - DNA, 27 bp, Artificial sequence
  SiRNA target sequence
aatctaaaatgtcgtatgttgcggccg

SEQ ID NO: 238774 - DNA, 27 bp, Artificial sequence
  SiRNA target sequence
atctaaaatgtcgtatgttgcggccga

SEQ ID NO: 238775 - DNA, 27 bp, Artificial sequence
  SiRNA target sequence
tctaaaatgtcgtatgttgcggccgaa

SEQ ID NO: 238776 - DNA, 27 bp, Artificial sequence
  SiRNA target sequence
ctaaaatgtcgtatgttgcggccgaaa

SEQ ID NO: 238777 - DNA, 27 bp, Artificial sequence
  SiRNA target sequence
taaaatgtcgtatgttgcggccgaaag

SEQ ID NO: 238778 - DNA, 27 bp, Artificial sequence
  SiRNA target sequence
aaaatgtcgtatgttgcggccgaaaga

SEQ ID NO: 238779 - DNA, 27 bp, Artificial sequence
  SiRNA target sequence
aaatgtcgtatgttgcggccgaaagat

SEQ ID NO: 238780 - DNA, 27 bp, Artificial sequence
  SiRNA target sequence
aatgtcgtatgttgcggccgaaagatt

SEQ ID NO: 238781 - DNA, 27 bp, Artificial sequence
  SiRNA target sequence
atgtcgtatgttgcggccgaaagattt

SEQ ID NO: 238782 - DNA, 27 bp, Artificial sequence
  SiRNA target sequence
tgtcgtatgttgcggccgaaagatttt

SEQ ID NO: 238783 - DNA, 27 bp, Artificial sequence
  SiRNA target sequence
gtcgtatgttgcggccgaaagattttt

SEQ ID NO: 238784 - DNA, 27 bp, Artificial sequence
  SiRNA target sequence
tcgtatgttgcggccgaaagatttttt

SEQ ID NO: 238785 - DNA, 27 bp, Artificial sequence
  SiRNA target sequence
cgtatgttgcggccgaaagatttttta

SEQ ID NO: 238786 - DNA, 27 bp, Artificial sequence
  SiRNA target sequence
gtatgttgcggccgaaagattttttaa

SEQ ID NO: 238787 - DNA, 27 bp, Artificial sequence
  SiRNA target sequence
tatgttgcggccgaaagattttttaat

SEQ ID NO: 238788 - DNA, 27 bp, Artificial sequence
  SiRNA target sequence
atgttgcggccgaaagattttttaatg

SEQ ID NO: 238789 - DNA, 27 bp, Artificial sequence
  SiRNA target sequence
tgttgcggccgaaagattttttaatgg

SEQ ID NO: 238790 - DNA, 27 bp, Artificial sequence
  SiRNA target sequence
gttgcggccgaaagattttttaatgga

SEQ ID NO: 238791 - DNA, 27 bp, Artificial sequence
  SiRNA target sequence
ttgcggccgaaagattttttaatggat

SEQ ID NO: 238792 - DNA, 27 bp, Artificial sequence
  SiRNA target sequence
tgcggccgaaagattttttaatggatt

SEQ ID NO: 238793 - DNA, 27 bp, Artificial sequence
  SiRNA target sequence
gcggccgaaagattttttaatggattt

SEQ ID NO: 238794 - DNA, 27 bp, Artificial sequence
  SiRNA target sequence
cggccgaaagattttttaatggatttt

SEQ ID NO: 238795 - DNA, 27 bp, Artificial sequence
  SiRNA target sequence
ggccgaaagattttttaatggattttt

SEQ ID NO: 238796 - DNA, 27 bp, Artificial sequence
  SiRNA target sequence
gccgaaagattttttaatggatttttt

SEQ ID NO: 238797 - DNA, 27 bp, Artificial sequence
  SiRNA target sequence
ccgaaagattttttaatggattttttt

SEQ ID NO: 238798 - DNA, 27 bp, Artificial sequence
  SiRNA target sequence
cgaaagattttttaatggatttttttg

SEQ ID NO: 238799 - DNA, 27 bp, Artificial sequence
  SiRNA target sequence
gaaagattttttaatggatttttttgt

SEQ ID NO: 238800 - DNA, 27 bp, Artificial sequence
  SiRNA target sequence
aaagattttttaatggatttttttgtc

SEQ ID NO: 238801 - DNA, 27 bp, Artificial sequence
  SiRNA target sequence
aagattttttaatggatttttttgtct

SEQ ID NO: 238802 - DNA, 27 bp, Artificial sequence
  SiRNA target sequence
agattttttaatggatttttttgtctg

SEQ ID NO: 238803 - DNA, 27 bp, Artificial sequence
  SiRNA target sequence
gattttttaatggatttttttgtctga

SEQ ID NO: 238804 - DNA, 27 bp, Artificial sequence
  SiRNA target sequence
attttttaatggatttttttgtctgag

SEQ ID NO: 238805 - DNA, 27 bp, Artificial sequence
  SiRNA target sequence
ttttttaatggatttttttgtctgagt

SEQ ID NO: 238806 - DNA, 27 bp, Artificial sequence
  SiRNA target sequence
tttttaatggatttttttgtctgagtg

SEQ ID NO: 238807 - DNA, 27 bp, Artificial sequence
  SiRNA target sequence
ttttaatggatttttttgtctgagtgg

SEQ ID NO: 238808 - DNA, 27 bp, Artificial sequence
  SiRNA target sequence
tttaatggatttttttgtctgagtgga

SEQ ID NO: 238809 - DNA, 27 bp, Artificial sequence
  SiRNA target sequence
ttaatggatttttttgtctgagtggaa

SEQ ID NO: 238810 - DNA, 27 bp, Artificial sequence
  SiRNA target sequence
taatggatttttttgtctgagtggaat

SEQ ID NO: 238811 - DNA, 27 bp, Artificial sequence
  SiRNA target sequence
aatggatttttttgtctgagtggaatt

SEQ ID NO: 238812 - DNA, 27 bp, Artificial sequence
  SiRNA target sequence
atggatttttttgtctgagtggaattc

SEQ ID NO: 238813 - DNA, 27 bp, Artificial sequence
  SiRNA target sequence
tggatttttttgtctgagtggaattct

SEQ ID NO: 238814 - DNA, 27 bp, Artificial sequence
  SiRNA target sequence
ggatttttttgtctgagtggaattctc

SEQ ID NO: 238815 - DNA, 27 bp, Artificial sequence
  SiRNA target sequence
gatttttttgtctgagtggaattctct

SEQ ID NO: 238816 - DNA, 27 bp, Artificial sequence
  SiRNA target sequence
atttttttgtctgagtggaattctctg

SEQ ID NO: 238817 - DNA, 27 bp, Artificial sequence
  SiRNA target sequence
tttttttgtctgagtggaattctctgt

SEQ ID NO: 238818 - DNA, 27 bp, Artificial sequence
  SiRNA target sequence
ttttttgtctgagtggaattctctgtg

SEQ ID NO: 238819 - DNA, 27 bp, Artificial sequence
  SiRNA target sequence
tttttgtctgagtggaattctctgtgc

SEQ ID NO: 238820 - DNA, 27 bp, Artificial sequence
  SiRNA target sequence
ttttgtctgagtggaattctctgtgct

SEQ ID NO: 238821 - DNA, 27 bp, Artificial sequence
  SiRNA target sequence
tttgtctgagtggaattctctgtgctg

SEQ ID NO: 238822 - DNA, 27 bp, Artificial sequence
  SiRNA target sequence
ttgtctgagtggaattctctgtgctgt

SEQ ID NO: 238823 - DNA, 27 bp, Artificial sequence
  SiRNA target sequence
tgtctgagtggaattctctgtgctgta

SEQ ID NO: 238824 - DNA, 27 bp, Artificial sequence
  SiRNA target sequence
gtctgagtggaattctctgtgctgtaa

SEQ ID NO: 238825 - DNA, 27 bp, Artificial sequence
  SiRNA target sequence
tctgagtggaattctctgtgctgtaat

SEQ ID NO: 238826 - DNA, 27 bp, Artificial sequence
  SiRNA target sequence
ctgagtggaattctctgtgctgtaatt

SEQ ID NO: 238827 - DNA, 27 bp, Artificial sequence
  SiRNA target sequence
tgagtggaattctctgtgctgtaattt

SEQ ID NO: 238828 - DNA, 27 bp, Artificial sequence
  SiRNA target sequence
gagtggaattctctgtgctgtaattta

SEQ ID NO: 238829 - DNA, 27 bp, Artificial sequence
  SiRNA target sequence
agtggaattctctgtgctgtaatttat

SEQ ID NO: 238830 - DNA, 27 bp, Artificial sequence
  SiRNA target sequence
gtggaattctctgtgctgtaatttatc

SEQ ID NO: 238831 - DNA, 27 bp, Artificial sequence
  SiRNA target sequence
tggaattctctgtgctgtaatttatct

SEQ ID NO: 238832 - DNA, 27 bp, Artificial sequence
  SiRNA target sequence
ggaattctctgtgctgtaatttatctt

SEQ ID NO: 238833 - DNA, 27 bp, Artificial sequence
  SiRNA target sequence
gaattctctgtgctgtaatttatcttc

SEQ ID NO: 238834 - DNA, 27 bp, Artificial sequence
  SiRNA target sequence
aattctctgtgctgtaatttatcttct

SEQ ID NO: 238835 - DNA, 27 bp, Artificial sequence
  SiRNA target sequence
attctctgtgctgtaatttatcttcta

SEQ ID NO: 238836 - DNA, 27 bp, Artificial sequence
  SiRNA target sequence
ttctctgtgctgtaatttatcttctaa

SEQ ID NO: 238837 - DNA, 27 bp, Artificial sequence
  SiRNA target sequence
tctctgtgctgtaatttatcttctaaa

SEQ ID NO: 238838 - DNA, 27 bp, Artificial sequence
  SiRNA target sequence
ctctgtgctgtaatttatcttctaaaa

SEQ ID NO: 238839 - DNA, 27 bp, Artificial sequence
  SiRNA target sequence
tctgtgctgtaatttatcttctaaaaa

SEQ ID NO: 238840 - DNA, 27 bp, Artificial sequence
  SiRNA target sequence
ctgtgctgtaatttatcttctaaaaaa

SEQ ID NO: 238841 - DNA, 27 bp, Artificial sequence
  SiRNA target sequence
tgtgctgtaatttatcttctaaaaaaa

SEQ ID NO: 238842 - DNA, 27 bp, Artificial sequence
  SiRNA target sequence
gtgctgtaatttatcttctaaaaaaat

SEQ ID NO: 238843 - DNA, 27 bp, Artificial sequence
  SiRNA target sequence
tgctgtaatttatcttctaaaaaaata

SEQ ID NO: 238844 - DNA, 27 bp, Artificial sequence
  SiRNA target sequence
gctgtaatttatcttctaaaaaaatat

SEQ ID NO: 238845 - DNA, 27 bp, Artificial sequence
  SiRNA target sequence
ctgtaatttatcttctaaaaaaatatt

SEQ ID NO: 238846 - DNA, 27 bp, Artificial sequence
  SiRNA target sequence
tgtaatttatcttctaaaaaaatattt

SEQ ID NO: 238847 - DNA, 27 bp, Artificial sequence
  SiRNA target sequence
gtaatttatcttctaaaaaaatattta

SEQ ID NO: 238848 - DNA, 27 bp, Artificial sequence
  SiRNA target sequence
taatttatcttctaaaaaaatatttag

SEQ ID NO: 238849 - DNA, 27 bp, Artificial sequence
  SiRNA target sequence
aatttatcttctaaaaaaatatttaga

SEQ ID NO: 238850 - DNA, 27 bp, Artificial sequence
  SiRNA target sequence
atttatcttctaaaaaaatatttagaa

SEQ ID NO: 238851 - DNA, 27 bp, Artificial sequence
  SiRNA target sequence
tttatcttctaaaaaaatatttagaaa

SEQ ID NO: 238852 - DNA, 27 bp, Artificial sequence
  SiRNA target sequence
ttatcttctaaaaaaatatttagaaaa

SEQ ID NO: 238853 - DNA, 27 bp, Artificial sequence
  SiRNA target sequence
tatcttctaaaaaaatatttagaaaat

SEQ ID NO: 238854 - DNA, 27 bp, Artificial sequence
  SiRNA target sequence
atcttctaaaaaaatatttagaaaata

SEQ ID NO: 238855 - DNA, 27 bp, Artificial sequence
  SiRNA target sequence
tcttctaaaaaaatatttagaaaataa

SEQ ID NO: 238856 - DNA, 27 bp, Artificial sequence
  SiRNA target sequence
cttctaaaaaaatatttagaaaataat

SEQ ID NO: 238857 - DNA, 27 bp, Artificial sequence
  SiRNA target sequence
ttctaaaaaaatatttagaaaataatg

SEQ ID NO: 238858 - DNA, 27 bp, Artificial sequence
  SiRNA target sequence
tctaaaaaaatatttagaaaataatgt

SEQ ID NO: 238859 - DNA, 27 bp, Artificial sequence
  SiRNA target sequence
ctaaaaaaatatttagaaaataatgtt

SEQ ID NO: 238860 - DNA, 27 bp, Artificial sequence
  SiRNA target sequence
taaaaaaatatttagaaaataatgtta

SEQ ID NO: 238861 - DNA, 27 bp, Artificial sequence
  SiRNA target sequence
aaaaaaatatttagaaaataatgttac

SEQ ID NO: 238862 - DNA, 27 bp, Artificial sequence
  SiRNA target sequence
aaaaaatatttagaaaataatgttact

SEQ ID NO: 238863 - DNA, 27 bp, Artificial sequence
  SiRNA target sequence
aaaaatatttagaaaataatgttacta

SEQ ID NO: 238864 - DNA, 27 bp, Artificial sequence
  SiRNA target sequence
aaaatatttagaaaataatgttactag

SEQ ID NO: 238865 - DNA, 27 bp, Artificial sequence
  SiRNA target sequence
aaatatttagaaaataatgttactagc

SEQ ID NO: 238866 - DNA, 27 bp, Artificial sequence
  SiRNA target sequence
aatatttagaaaataatgttactagca

SEQ ID NO: 238867 - DNA, 27 bp, Artificial sequence
  SiRNA target sequence
atatttagaaaataatgttactagcaa

SEQ ID NO: 238868 - DNA, 27 bp, Artificial sequence
  SiRNA target sequence
tatttagaaaataatgttactagcaaa

SEQ ID NO: 238869 - DNA, 27 bp, Artificial sequence
  SiRNA target sequence
atttagaaaataatgttactagcaaac

SEQ ID NO: 238870 - DNA, 27 bp, Artificial sequence
  SiRNA target sequence
tttagaaaataatgttactagcaaacc

SEQ ID NO: 238871 - DNA, 27 bp, Artificial sequence
  SiRNA target sequence
ttagaaaataatgttactagcaaacca

SEQ ID NO: 238872 - DNA, 27 bp, Artificial sequence
  SiRNA target sequence
tagaaaataatgttactagcaaaccaa

SEQ ID NO: 238873 - DNA, 27 bp, Artificial sequence
  SiRNA target sequence
agaaaataatgttactagcaaaccaat

SEQ ID NO: 238874 - DNA, 27 bp, Artificial sequence
  SiRNA target sequence
gaaaataatgttactagcaaaccaatg

SEQ ID NO: 238875 - DNA, 27 bp, Artificial sequence
  SiRNA target sequence
aaaataatgttactagcaaaccaatgt

SEQ ID NO: 238876 - DNA, 27 bp, Artificial sequence
  SiRNA target sequence
aaataatgttactagcaaaccaatgtt

SEQ ID NO: 238877 - DNA, 27 bp, Artificial sequence
  SiRNA target sequence
aataatgttactagcaaaccaatgttt

SEQ ID NO: 238878 - DNA, 27 bp, Artificial sequence
  SiRNA target sequence
ataatgttactagcaaaccaatgtttg

SEQ ID NO: 238879 - DNA, 27 bp, Artificial sequence
  SiRNA target sequence
taatgttactagcaaaccaatgtttgt

SEQ ID NO: 238880 - DNA, 27 bp, Artificial sequence
  SiRNA target sequence
aatgttactagcaaaccaatgtttgtt

SEQ ID NO: 238881 - DNA, 27 bp, Artificial sequence
  SiRNA target sequence
atgttactagcaaaccaatgtttgtta

SEQ ID NO: 238882 - DNA, 27 bp, Artificial sequence
  SiRNA target sequence
tgttactagcaaaccaatgtttgttag

SEQ ID NO: 238883 - DNA, 27 bp, Artificial sequence
  SiRNA target sequence
gttactagcaaaccaatgtttgttaga

SEQ ID NO: 238884 - DNA, 27 bp, Artificial sequence
  SiRNA target sequence
ttactagcaaaccaatgtttgttagaa

SEQ ID NO: 238885 - DNA, 27 bp, Artificial sequence
  SiRNA target sequence
tactagcaaaccaatgtttgttagaaa

SEQ ID NO: 238886 - DNA, 27 bp, Artificial sequence
  SiRNA target sequence
actagcaaaccaatgtttgttagaaag

SEQ ID NO: 238887 - DNA, 27 bp, Artificial sequence
  SiRNA target sequence
ctagcaaaccaatgtttgttagaaaga

SEQ ID NO: 238888 - DNA, 27 bp, Artificial sequence
  SiRNA target sequence
tagcaaaccaatgtttgttagaaagac

SEQ ID NO: 238889 - DNA, 27 bp, Artificial sequence
  SiRNA target sequence
agcaaaccaatgtttgttagaaagact

SEQ ID NO: 238890 - DNA, 27 bp, Artificial sequence
  SiRNA target sequence
gcaaaccaatgtttgttagaaagactt

SEQ ID NO: 238891 - DNA, 27 bp, Artificial sequence
  SiRNA target sequence
caaaccaatgtttgttagaaagacttt

SEQ ID NO: 238892 - DNA, 27 bp, Artificial sequence
  SiRNA target sequence
aaaccaatgtttgttagaaagactttt

SEQ ID NO: 238893 - DNA, 27 bp, Artificial sequence
  SiRNA target sequence
aaccaatgtttgttagaaagactttta

SEQ ID NO: 238894 - DNA, 27 bp, Artificial sequence
  SiRNA target sequence
accaatgtttgttagaaagacttttac

SEQ ID NO: 238895 - DNA, 27 bp, Artificial sequence
  SiRNA target sequence
ccaatgtttgttagaaagacttttact

SEQ ID NO: 238896 - DNA, 27 bp, Artificial sequence
  SiRNA target sequence
caatgtttgttagaaagacttttacta

SEQ ID NO: 238897 - DNA, 27 bp, Artificial sequence
  SiRNA target sequence
aatgtttgttagaaagacttttactaa

SEQ ID NO: 238898 - DNA, 27 bp, Artificial sequence
  SiRNA target sequence
atgtttgttagaaagacttttactaaa

SEQ ID NO: 238899 - DNA, 27 bp, Artificial sequence
  SiRNA target sequence
tgtttgttagaaagacttttactaaaa

SEQ ID NO: 238900 - DNA, 27 bp, Artificial sequence
  SiRNA target sequence
gtttgttagaaagacttttactaaaaa

SEQ ID NO: 238901 - DNA, 27 bp, Artificial sequence
  SiRNA target sequence
tttgttagaaagacttttactaaaaag

SEQ ID NO: 238902 - DNA, 27 bp, Artificial sequence
  SiRNA target sequence
ttgttagaaagacttttactaaaaaga

SEQ ID NO: 238903 - DNA, 27 bp, Artificial sequence
  SiRNA target sequence
tgttagaaagacttttactaaaaagaa

SEQ ID NO: 238904 - DNA, 27 bp, Artificial sequence
  SiRNA target sequence
gttagaaagacttttactaaaaagaag

SEQ ID NO: 238905 - DNA, 27 bp, Artificial sequence
  SiRNA target sequence
ttagaaagacttttactaaaaagaaga

SEQ ID NO: 238906 - DNA, 27 bp, Artificial sequence
  SiRNA target sequence
tagaaagacttttactaaaaagaagag

SEQ ID NO: 238907 - DNA, 27 bp, Artificial sequence
  SiRNA target sequence
agaaagacttttactaaaaagaagagt

SEQ ID NO: 238908 - DNA, 27 bp, Artificial sequence
  SiRNA target sequence
gaaagacttttactaaaaagaagagta

SEQ ID NO: 238909 - DNA, 27 bp, Artificial sequence
  SiRNA target sequence
aaagacttttactaaaaagaagagtaa

SEQ ID NO: 238910 - DNA, 27 bp, Artificial sequence
  SiRNA target sequence
aagacttttactaaaaagaagagtaaa

SEQ ID NO: 238911 - DNA, 27 bp, Artificial sequence
  SiRNA target sequence
agacttttactaaaaagaagagtaaag

SEQ ID NO: 238912 - DNA, 27 bp, Artificial sequence
  SiRNA target sequence
gacttttactaaaaagaagagtaaagt

SEQ ID NO: 238913 - DNA, 27 bp, Artificial sequence
  SiRNA target sequence
acttttactaaaaagaagagtaaagtg

SEQ ID NO: 238914 - DNA, 27 bp, Artificial sequence
  SiRNA target sequence
cttttactaaaaagaagagtaaagtga

SEQ ID NO: 238915 - DNA, 27 bp, Artificial sequence
  SiRNA target sequence
ttttactaaaaagaagagtaaagtgaa

SEQ ID NO: 238916 - DNA, 27 bp, Artificial sequence
  SiRNA target sequence
tttactaaaaagaagagtaaagtgaag

SEQ ID NO: 238917 - DNA, 27 bp, Artificial sequence
  SiRNA target sequence
ttactaaaaagaagagtaaagtgaagg

SEQ ID NO: 238918 - DNA, 27 bp, Artificial sequence
  SiRNA target sequence
tactaaaaagaagagtaaagtgaaggt

SEQ ID NO: 238919 - DNA, 27 bp, Artificial sequence
  SiRNA target sequence
actaaaaagaagagtaaagtgaaggtt

SEQ ID NO: 238920 - DNA, 27 bp, Artificial sequence
  SiRNA target sequence
ctaaaaagaagagtaaagtgaaggttg

SEQ ID NO: 238921 - DNA, 27 bp, Artificial sequence
  SiRNA target sequence
taaaaagaagagtaaagtgaaggttgg

SEQ ID NO: 238922 - DNA, 27 bp, Artificial sequence
  SiRNA target sequence
aaaaagaagagtaaagtgaaggttgga

SEQ ID NO: 238923 - DNA, 27 bp, Artificial sequence
  SiRNA target sequence
aaaagaagagtaaagtgaaggttggat

SEQ ID NO: 238924 - DNA, 27 bp, Artificial sequence
  SiRNA target sequence
aaagaagagtaaagtgaaggttggatt

SEQ ID NO: 238925 - DNA, 27 bp, Artificial sequence
  SiRNA target sequence
aagaagagtaaagtgaaggttggattt

SEQ ID NO: 238926 - DNA, 27 bp, Artificial sequence
  SiRNA target sequence
agaagagtaaagtgaaggttggatttg

SEQ ID NO: 238927 - DNA, 27 bp, Artificial sequence
  SiRNA target sequence
gaagagtaaagtgaaggttggatttgt

SEQ ID NO: 238928 - DNA, 27 bp, Artificial sequence
  SiRNA target sequence
aagagtaaagtgaaggttggatttgtt

SEQ ID NO: 238929 - DNA, 27 bp, Artificial sequence
  SiRNA target sequence
agagtaaagtgaaggttggatttgttg

SEQ ID NO: 238930 - DNA, 27 bp, Artificial sequence
  SiRNA target sequence
gagtaaagtgaaggttggatttgttga

SEQ ID NO: 238931 - DNA, 27 bp, Artificial sequence
  SiRNA target sequence
agtaaagtgaaggttggatttgttgat

SEQ ID NO: 238932 - DNA, 27 bp, Artificial sequence
  SiRNA target sequence
gtaaagtgaaggttggatttgttgatg

SEQ ID NO: 238933 - DNA, 27 bp, Artificial sequence
  SiRNA target sequence
taaagtgaaggttggatttgttgatgg

SEQ ID NO: 238934 - DNA, 27 bp, Artificial sequence
  SiRNA target sequence
aaagtgaaggttggatttgttgatgga

SEQ ID NO: 238935 - DNA, 27 bp, Artificial sequence
  SiRNA target sequence
aagtgaaggttggatttgttgatggac

SEQ ID NO: 238936 - DNA, 27 bp, Artificial sequence
  SiRNA target sequence
agtgaaggttggatttgttgatggact

SEQ ID NO: 238937 - DNA, 27 bp, Artificial sequence
  SiRNA target sequence
gtgaaggttggatttgttgatggactt

SEQ ID NO: 238938 - DNA, 27 bp, Artificial sequence
  SiRNA target sequence
tgaaggttggatttgttgatggactta

SEQ ID NO: 238939 - DNA, 27 bp, Artificial sequence
  SiRNA target sequence
gaaggttggatttgttgatggacttat

SEQ ID NO: 238940 - DNA, 27 bp, Artificial sequence
  SiRNA target sequence
aaggttggatttgttgatggacttatt

SEQ ID NO: 238941 - DNA, 27 bp, Artificial sequence
  SiRNA target sequence
aggttggatttgttgatggacttattg

SEQ ID NO: 238942 - DNA, 27 bp, Artificial sequence
  SiRNA target sequence
ggttggatttgttgatggacttattga

SEQ ID NO: 238943 - DNA, 27 bp, Artificial sequence
  SiRNA target sequence
gttggatttgttgatggacttattgag

SEQ ID NO: 238944 - DNA, 27 bp, Artificial sequence
  SiRNA target sequence
ttggatttgttgatggacttattgaga

SEQ ID NO: 238945 - DNA, 27 bp, Artificial sequence
  SiRNA target sequence
tggatttgttgatggacttattgagat

SEQ ID NO: 238946 - DNA, 27 bp, Artificial sequence
  SiRNA target sequence
ggatttgttgatggacttattgagatg

SEQ ID NO: 238947 - DNA, 27 bp, Artificial sequence
  SiRNA target sequence
gatttgttgatggacttattgagatga

SEQ ID NO: 238948 - DNA, 27 bp, Artificial sequence
  SiRNA target sequence
atttgttgatggacttattgagatgag

SEQ ID NO: 238949 - DNA, 27 bp, Artificial sequence
  SiRNA target sequence
tttgttgatggacttattgagatgagt

SEQ ID NO: 238950 - DNA, 27 bp, Artificial sequence
  SiRNA target sequence
ttgttgatggacttattgagatgagta

SEQ ID NO: 238951 - DNA, 27 bp, Artificial sequence
  SiRNA target sequence
tgttgatggacttattgagatgagtaa

SEQ ID NO: 238952 - DNA, 27 bp, Artificial sequence
  SiRNA target sequence
gttgatggacttattgagatgagtaaa

SEQ ID NO: 238953 - DNA, 27 bp, Artificial sequence
  SiRNA target sequence
ttgatggacttattgagatgagtaaat

SEQ ID NO: 238954 - DNA, 27 bp, Artificial sequence
  SiRNA target sequence
tgatggacttattgagatgagtaaatc

SEQ ID NO: 238955 - DNA, 27 bp, Artificial sequence
  SiRNA target sequence
gatggacttattgagatgagtaaatct

SEQ ID NO: 238956 - DNA, 27 bp, Artificial sequence
  SiRNA target sequence
atggacttattgagatgagtaaatcta

SEQ ID NO: 238957 - DNA, 27 bp, Artificial sequence
  SiRNA target sequence
tggacttattgagatgagtaaatctaa

SEQ ID NO: 238958 - DNA, 27 bp, Artificial sequence
  SiRNA target sequence
ggacttattgagatgagtaaatctaaa

SEQ ID NO: 238959 - DNA, 27 bp, Artificial sequence
  SiRNA target sequence
gacttattgagatgagtaaatctaaac

SEQ ID NO: 238960 - DNA, 27 bp, Artificial sequence
  SiRNA target sequence
acttattgagatgagtaaatctaaact

SEQ ID NO: 238961 - DNA, 27 bp, Artificial sequence
  SiRNA target sequence
cttattgagatgagtaaatctaaacta

SEQ ID NO: 238962 - DNA, 27 bp, Artificial sequence
  SiRNA target sequence
ttattgagatgagtaaatctaaactac

SEQ ID NO: 238963 - DNA, 27 bp, Artificial sequence
  SiRNA target sequence
tattgagatgagtaaatctaaactact

SEQ ID NO: 238964 - DNA, 27 bp, Artificial sequence
  SiRNA target sequence
attgagatgagtaaatctaaactactg

SEQ ID NO: 238965 - DNA, 27 bp, Artificial sequence
  SiRNA target sequence
ttgagatgagtaaatctaaactactgt

SEQ ID NO: 238966 - DNA, 27 bp, Artificial sequence
  SiRNA target sequence
tgagatgagtaaatctaaactactgtt

SEQ ID NO: 238967 - DNA, 27 bp, Artificial sequence
  SiRNA target sequence
gagatgagtaaatctaaactactgttg

SEQ ID NO: 238968 - DNA, 27 bp, Artificial sequence
  SiRNA target sequence
agatgagtaaatctaaactactgttga

SEQ ID NO: 238969 - DNA, 27 bp, Artificial sequence
  SiRNA target sequence
gatgagtaaatctaaactactgttgaa

SEQ ID NO: 238970 - DNA, 27 bp, Artificial sequence
  SiRNA target sequence
atgagtaaatctaaactactgttgaat

SEQ ID NO: 238971 - DNA, 27 bp, Artificial sequence
  SiRNA target sequence
tgagtaaatctaaactactgttgaata

SEQ ID NO: 238972 - DNA, 27 bp, Artificial sequence
  SiRNA target sequence
gagtaaatctaaactactgttgaatat

SEQ ID NO: 238973 - DNA, 27 bp, Artificial sequence
  SiRNA target sequence
agtaaatctaaactactgttgaatatg

SEQ ID NO: 238974 - DNA, 27 bp, Artificial sequence
  SiRNA target sequence
gtaaatctaaactactgttgaatatgt

SEQ ID NO: 238975 - DNA, 27 bp, Artificial sequence
  SiRNA target sequence
taaatctaaactactgttgaatatgtc

SEQ ID NO: 238976 - DNA, 27 bp, Artificial sequence
  SiRNA target sequence
aaatctaaactactgttgaatatgtca

SEQ ID NO: 238977 - DNA, 27 bp, Artificial sequence
  SiRNA target sequence
aatctaaactactgttgaatatgtcat

SEQ ID NO: 238978 - DNA, 27 bp, Artificial sequence
  SiRNA target sequence
atctaaactactgttgaatatgtcatt

SEQ ID NO: 238979 - DNA, 27 bp, Artificial sequence
  SiRNA target sequence
tctaaactactgttgaatatgtcatta

SEQ ID NO: 238980 - DNA, 27 bp, Artificial sequence
  SiRNA target sequence
ctaaactactgttgaatatgtcattag

SEQ ID NO: 238981 - DNA, 27 bp, Artificial sequence
  SiRNA target sequence
taaactactgttgaatatgtcattagt

SEQ ID NO: 238982 - DNA, 27 bp, Artificial sequence
  SiRNA target sequence
aaactactgttgaatatgtcattagtc

SEQ ID NO: 238983 - DNA, 27 bp, Artificial sequence
  SiRNA target sequence
aactactgttgaatatgtcattagtcg

SEQ ID NO: 238984 - DNA, 27 bp, Artificial sequence
  SiRNA target sequence
actactgttgaatatgtcattagtcgt

SEQ ID NO: 238985 - DNA, 27 bp, Artificial sequence
  SiRNA target sequence
ctactgttgaatatgtcattagtcgta

SEQ ID NO: 238986 - DNA, 27 bp, Artificial sequence
  SiRNA target sequence
tactgttgaatatgtcattagtcgtat

SEQ ID NO: 238987 - DNA, 27 bp, Artificial sequence
  SiRNA target sequence
actgttgaatatgtcattagtcgtatt

SEQ ID NO: 238988 - DNA, 27 bp, Artificial sequence
  SiRNA target sequence
ctgttgaatatgtcattagtcgtatta

SEQ ID NO: 238989 - DNA, 27 bp, Artificial sequence
  SiRNA target sequence
tgttgaatatgtcattagtcgtattat

SEQ ID NO: 238990 - DNA, 27 bp, Artificial sequence
  SiRNA target sequence
gttgaatatgtcattagtcgtattatt

SEQ ID NO: 238991 - DNA, 27 bp, Artificial sequence
  SiRNA target sequence
ttgaatatgtcattagtcgtattattt

SEQ ID NO: 238992 - DNA, 27 bp, Artificial sequence
  SiRNA target sequence
tgaatatgtcattagtcgtattatttt

SEQ ID NO: 238993 - DNA, 27 bp, Artificial sequence
  SiRNA target sequence
gaatatgtcattagtcgtattatttta

SEQ ID NO: 238994 - DNA, 27 bp, Artificial sequence
  SiRNA target sequence
aatatgtcattagtcgtattattttat

SEQ ID NO: 238995 - DNA, 27 bp, Artificial sequence
  SiRNA target sequence
atatgtcattagtcgtattattttatg

SEQ ID NO: 238996 - DNA, 27 bp, Artificial sequence
  SiRNA target sequence
tatgtcattagtcgtattattttatgc

SEQ ID NO: 238997 - DNA, 27 bp, Artificial sequence
  SiRNA target sequence
atgtcattagtcgtattattttatgct

SEQ ID NO: 238998 - DNA, 27 bp, Artificial sequence
  SiRNA target sequence
tgtcattagtcgtattattttatgctg

SEQ ID NO: 238999 - DNA, 27 bp, Artificial sequence
  SiRNA target sequence
gtcattagtcgtattattttatgctgt

SEQ ID NO: 239000 - DNA, 27 bp, Artificial sequence
  SiRNA target sequence
tcattagtcgtattattttatgctgtt

SEQ ID NO: 239001 - DNA, 27 bp, Artificial sequence
  SiRNA target sequence
cattagtcgtattattttatgctgttt

SEQ ID NO: 239002 - DNA, 27 bp, Artificial sequence
  SiRNA target sequence
attagtcgtattattttatgctgtttc

SEQ ID NO: 239003 - DNA, 27 bp, Artificial sequence
  SiRNA target sequence
ttagtcgtattattttatgctgtttct

SEQ ID NO: 239004 - DNA, 27 bp, Artificial sequence
  SiRNA target sequence
tagtcgtattattttatgctgtttcta

SEQ ID NO: 239005 - DNA, 27 bp, Artificial sequence
  SiRNA target sequence
agtcgtattattttatgctgtttctac

SEQ ID NO: 239006 - DNA, 27 bp, Artificial sequence
  SiRNA target sequence
gtcgtattattttatgctgtttctacg

SEQ ID NO: 239007 - DNA, 27 bp, Artificial sequence
  SiRNA target sequence
tcgtattattttatgctgtttctacga

SEQ ID NO: 239008 - DNA, 27 bp, Artificial sequence
  SiRNA target sequence
cgtattattttatgctgtttctacgaa

SEQ ID NO: 239009 - DNA, 27 bp, Artificial sequence
  SiRNA target sequence
gtattattttatgctgtttctacgaat

SEQ ID NO: 239010 - DNA, 27 bp, Artificial sequence
  SiRNA target sequence
tattattttatgctgtttctacgaata

SEQ ID NO: 239011 - DNA, 27 bp, Artificial sequence
  SiRNA target sequence
attattttatgctgtttctacgaatat

SEQ ID NO: 239012 - DNA, 27 bp, Artificial sequence
  SiRNA target sequence
ttattttatgctgtttctacgaatatt

SEQ ID NO: 239013 - DNA, 27 bp, Artificial sequence
  SiRNA target sequence
tattttatgctgtttctacgaatatta

SEQ ID NO: 239014 - DNA, 27 bp, Artificial sequence
  SiRNA target sequence
attttatgctgtttctacgaatattat

SEQ ID NO: 239015 - DNA, 27 bp, Artificial sequence
  SiRNA target sequence
ttttatgctgtttctacgaatattatt

SEQ ID NO: 239016 - DNA, 27 bp, Artificial sequence
  SiRNA target sequence
tttatgctgtttctacgaatattattg

SEQ ID NO: 239017 - DNA, 27 bp, Artificial sequence
  SiRNA target sequence
ttatgctgtttctacgaatattattga

SEQ ID NO: 239018 - DNA, 27 bp, Artificial sequence
  SiRNA target sequence
tatgctgtttctacgaatattattgag

SEQ ID NO: 239019 - DNA, 27 bp, Artificial sequence
  SiRNA target sequence
atgctgtttctacgaatattattgagt

SEQ ID NO: 239020 - DNA, 27 bp, Artificial sequence
  SiRNA target sequence
tgctgtttctacgaatattattgagtc

SEQ ID NO: 239021 - DNA, 27 bp, Artificial sequence
  SiRNA target sequence
gctgtttctacgaatattattgagtca

SEQ ID NO: 239022 - DNA, 27 bp, Artificial sequence
  SiRNA target sequence
ctgtttctacgaatattattgagtcag

SEQ ID NO: 239023 - DNA, 27 bp, Artificial sequence
  SiRNA target sequence
tgtttctacgaatattattgagtcagc

SEQ ID NO: 239024 - DNA, 27 bp, Artificial sequence
  SiRNA target sequence
gtttctacgaatattattgagtcagct

SEQ ID NO: 239025 - DNA, 27 bp, Artificial sequence
  SiRNA target sequence
tttctacgaatattattgagtcagctt

SEQ ID NO: 239026 - DNA, 27 bp, Artificial sequence
  SiRNA target sequence
ttctacgaatattattgagtcagctta

SEQ ID NO: 239027 - DNA, 27 bp, Artificial sequence
  SiRNA target sequence
tctacgaatattattgagtcagcttat

SEQ ID NO: 239028 - DNA, 27 bp, Artificial sequence
  SiRNA target sequence
ctacgaatattattgagtcagcttata

SEQ ID NO: 239029 - DNA, 27 bp, Artificial sequence
  SiRNA target sequence
tacgaatattattgagtcagcttataa

SEQ ID NO: 239030 - DNA, 27 bp, Artificial sequence
  SiRNA target sequence
acgaatattattgagtcagcttataaa

SEQ ID NO: 239031 - DNA, 27 bp, Artificial sequence
  SiRNA target sequence
cgaatattattgagtcagcttataaat

SEQ ID NO: 239032 - DNA, 27 bp, Artificial sequence
  SiRNA target sequence
gaatattattgagtcagcttataaatc

SEQ ID NO: 239033 - DNA, 27 bp, Artificial sequence
  SiRNA target sequence
aatattattgagtcagcttataaatct

SEQ ID NO: 239034 - DNA, 27 bp, Artificial sequence
  SiRNA target sequence
atattattgagtcagcttataaatctg

SEQ ID NO: 239035 - DNA, 27 bp, Artificial sequence
  SiRNA target sequence
tattattgagtcagcttataaatctgc

SEQ ID NO: 239036 - DNA, 27 bp, Artificial sequence
  SiRNA target sequence
attattgagtcagcttataaatctgct

SEQ ID NO: 239037 - DNA, 27 bp, Artificial sequence
  SiRNA target sequence
ttattgagtcagcttataaatctgctt

SEQ ID NO: 239038 - DNA, 27 bp, Artificial sequence
  SiRNA target sequence
tattgagtcagcttataaatctgcttt

SEQ ID NO: 239039 - DNA, 27 bp, Artificial sequence
  SiRNA target sequence
attgagtcagcttataaatctgcttta

SEQ ID NO: 239040 - DNA, 27 bp, Artificial sequence
  SiRNA target sequence
ttgagtcagcttataaatctgctttag

SEQ ID NO: 239041 - DNA, 27 bp, Artificial sequence
  SiRNA target sequence
tgagtcagcttataaatctgctttagc

SEQ ID NO: 239042 - DNA, 27 bp, Artificial sequence
  SiRNA target sequence
gagtcagcttataaatctgctttagct

SEQ ID NO: 239043 - DNA, 27 bp, Artificial sequence
  SiRNA target sequence
agtcagcttataaatctgctttagctg

SEQ ID NO: 239044 - DNA, 27 bp, Artificial sequence
  SiRNA target sequence
gtcagcttataaatctgctttagctgt

SEQ ID NO: 239045 - DNA, 27 bp, Artificial sequence
  SiRNA target sequence
tcagcttataaatctgctttagctgtc

SEQ ID NO: 239046 - DNA, 27 bp, Artificial sequence
  SiRNA target sequence
cagcttataaatctgctttagctgtcg

SEQ ID NO: 239047 - DNA, 27 bp, Artificial sequence
  SiRNA target sequence
agcttataaatctgctttagctgtcgg

SEQ ID NO: 239048 - DNA, 27 bp, Artificial sequence
  SiRNA target sequence
gcttataaatctgctttagctgtcggt

SEQ ID NO: 239049 - DNA, 27 bp, Artificial sequence
  SiRNA target sequence
cttataaatctgctttagctgtcggtg

SEQ ID NO: 239050 - DNA, 27 bp, Artificial sequence
  SiRNA target sequence
ttataaatctgctttagctgtcggtgc

SEQ ID NO: 239051 - DNA, 27 bp, Artificial sequence
  SiRNA target sequence
tataaatctgctttagctgtcggtgct

SEQ ID NO: 239052 - DNA, 27 bp, Artificial sequence
  SiRNA target sequence
ataaatctgctttagctgtcggtgcta

SEQ ID NO: 239053 - DNA, 27 bp, Artificial sequence
  SiRNA target sequence
taaatctgctttagctgtcggtgctaa

SEQ ID NO: 239054 - DNA, 27 bp, Artificial sequence
  SiRNA target sequence
aaatctgctttagctgtcggtgctaat

SEQ ID NO: 239055 - DNA, 27 bp, Artificial sequence
  SiRNA target sequence
aatctgctttagctgtcggtgctaatg

SEQ ID NO: 239056 - DNA, 27 bp, Artificial sequence
  SiRNA target sequence
atctgctttagctgtcggtgctaatga

SEQ ID NO: 239057 - DNA, 27 bp, Artificial sequence
  SiRNA target sequence
tctgctttagctgtcggtgctaatgaa

SEQ ID NO: 239058 - DNA, 27 bp, Artificial sequence
  SiRNA target sequence
ctgctttagctgtcggtgctaatgaaa

SEQ ID NO: 239059 - DNA, 27 bp, Artificial sequence
  SiRNA target sequence
tgctttagctgtcggtgctaatgaaac

SEQ ID NO: 239060 - DNA, 27 bp, Artificial sequence
  SiRNA target sequence
gctttagctgtcggtgctaatgaaact

SEQ ID NO: 239061 - DNA, 27 bp, Artificial sequence
  SiRNA target sequence
ctttagctgtcggtgctaatgaaactg

SEQ ID NO: 239062 - DNA, 27 bp, Artificial sequence
  SiRNA target sequence
tttagctgtcggtgctaatgaaactgg

SEQ ID NO: 239063 - DNA, 27 bp, Artificial sequence
  SiRNA target sequence
ttagctgtcggtgctaatgaaactggt

SEQ ID NO: 239064 - DNA, 27 bp, Artificial sequence
  SiRNA target sequence
tagctgtcggtgctaatgaaactggtg

SEQ ID NO: 239065 - DNA, 27 bp, Artificial sequence
  SiRNA target sequence
agctgtcggtgctaatgaaactggtga

SEQ ID NO: 239066 - DNA, 27 bp, Artificial sequence
  SiRNA target sequence
gctgtcggtgctaatgaaactggtgag

SEQ ID NO: 239067 - DNA, 27 bp, Artificial sequence
  SiRNA target sequence
ctgtcggtgctaatgaaactggtgagg

SEQ ID NO: 239068 - DNA, 27 bp, Artificial sequence
  SiRNA target sequence
tgtcggtgctaatgaaactggtgaggc

SEQ ID NO: 239069 - DNA, 27 bp, Artificial sequence
  SiRNA target sequence
gtcggtgctaatgaaactggtgaggca

SEQ ID NO: 239070 - DNA, 27 bp, Artificial sequence
  SiRNA target sequence
tcggtgctaatgaaactggtgaggcaa

SEQ ID NO: 239071 - DNA, 27 bp, Artificial sequence
  SiRNA target sequence
cggtgctaatgaaactggtgaggcaaa

SEQ ID NO: 239072 - DNA, 27 bp, Artificial sequence
  SiRNA target sequence
ggtgctaatgaaactggtgaggcaaaa

SEQ ID NO: 239073 - DNA, 27 bp, Artificial sequence
  SiRNA target sequence
gtgctaatgaaactggtgaggcaaaat

SEQ ID NO: 239074 - DNA, 27 bp, Artificial sequence
  SiRNA target sequence
tgctaatgaaactggtgaggcaaaatc

SEQ ID NO: 239075 - DNA, 27 bp, Artificial sequence
  SiRNA target sequence
gctaatgaaactggtgaggcaaaatct

SEQ ID NO: 239076 - DNA, 27 bp, Artificial sequence
  SiRNA target sequence
ctaatgaaactggtgaggcaaaatcta

SEQ ID NO: 239077 - DNA, 27 bp, Artificial sequence
  SiRNA target sequence
taatgaaactggtgaggcaaaatctac

SEQ ID NO: 239078 - DNA, 27 bp, Artificial sequence
  SiRNA target sequence
aatgaaactggtgaggcaaaatctacc

SEQ ID NO: 239079 - DNA, 27 bp, Artificial sequence
  SiRNA target sequence
atgaaactggtgaggcaaaatctacct

SEQ ID NO: 239080 - DNA, 27 bp, Artificial sequence
  SiRNA target sequence
tgaaactggtgaggcaaaatctaccta

SEQ ID NO: 239081 - DNA, 27 bp, Artificial sequence
  SiRNA target sequence
gaaactggtgaggcaaaatctacctat

SEQ ID NO: 239082 - DNA, 27 bp, Artificial sequence
  SiRNA target sequence
aaactggtgaggcaaaatctacctatg

SEQ ID NO: 239083 - DNA, 27 bp, Artificial sequence
  SiRNA target sequence
aactggtgaggcaaaatctacctatgc

SEQ ID NO: 239084 - DNA, 27 bp, Artificial sequence
  SiRNA target sequence
actggtgaggcaaaatctacctatgct

SEQ ID NO: 239085 - DNA, 27 bp, Artificial sequence
  SiRNA target sequence
ctggtgaggcaaaatctacctatgctt

SEQ ID NO: 239086 - DNA, 27 bp, Artificial sequence
  SiRNA target sequence
tggtgaggcaaaatctacctatgcttc

SEQ ID NO: 239087 - DNA, 27 bp, Artificial sequence
  SiRNA target sequence
ggtgaggcaaaatctacctatgcttca

SEQ ID NO: 239088 - DNA, 27 bp, Artificial sequence
  SiRNA target sequence
gtgaggcaaaatctacctatgcttcaa

SEQ ID NO: 239089 - DNA, 27 bp, Artificial sequence
  SiRNA target sequence
tgaggcaaaatctacctatgcttcaat

SEQ ID NO: 239090 - DNA, 27 bp, Artificial sequence
  SiRNA target sequence
gaggcaaaatctacctatgcttcaatt

SEQ ID NO: 239091 - DNA, 27 bp, Artificial sequence
  SiRNA target sequence
aggcaaaatctacctatgcttcaattt

SEQ ID NO: 239092 - DNA, 27 bp, Artificial sequence
  SiRNA target sequence
ggcaaaatctacctatgcttcaattta

SEQ ID NO: 239093 - DNA, 27 bp, Artificial sequence
  SiRNA target sequence
gcaaaatctacctatgcttcaatttat

SEQ ID NO: 239094 - DNA, 27 bp, Artificial sequence
  SiRNA target sequence
caaaatctacctatgcttcaatttata

SEQ ID NO: 239095 - DNA, 27 bp, Artificial sequence
  SiRNA target sequence
aaaatctacctatgcttcaatttatac

SEQ ID NO: 239096 - DNA, 27 bp, Artificial sequence
  SiRNA target sequence
aaatctacctatgcttcaatttataca

SEQ ID NO: 239097 - DNA, 27 bp, Artificial sequence
  SiRNA target sequence
aatctacctatgcttcaatttatacat

SEQ ID NO: 239098 - DNA, 27 bp, Artificial sequence
  SiRNA target sequence
atctacctatgcttcaatttatacatc

SEQ ID NO: 239099 - DNA, 27 bp, Artificial sequence
  SiRNA target sequence
tctacctatgcttcaatttatacatca

SEQ ID NO: 239100 - DNA, 27 bp, Artificial sequence
  SiRNA target sequence
ctacctatgcttcaatttatacatcaa

SEQ ID NO: 239101 - DNA, 27 bp, Artificial sequence
  SiRNA target sequence
tacctatgcttcaatttatacatcaat

SEQ ID NO: 239102 - DNA, 27 bp, Artificial sequence
  SiRNA target sequence
acctatgcttcaatttatacatcaatt

SEQ ID NO: 239103 - DNA, 27 bp, Artificial sequence
  SiRNA target sequence
cctatgcttcaatttatacatcaattg

SEQ ID NO: 239104 - DNA, 27 bp, Artificial sequence
  SiRNA target sequence
ctatgcttcaatttatacatcaattga

SEQ ID NO: 239105 - DNA, 27 bp, Artificial sequence
  SiRNA target sequence
tatgcttcaatttatacatcaattgaa

SEQ ID NO: 239106 - DNA, 27 bp, Artificial sequence
  SiRNA target sequence
atgcttcaatttatacatcaattgaac

SEQ ID NO: 239107 - DNA, 27 bp, Artificial sequence
  SiRNA target sequence
tgcttcaatttatacatcaattgaaca

SEQ ID NO: 239108 - DNA, 27 bp, Artificial sequence
  SiRNA target sequence
gcttcaatttatacatcaattgaacaa

SEQ ID NO: 239109 - DNA, 27 bp, Artificial sequence
  SiRNA target sequence
cttcaatttatacatcaattgaacaat

SEQ ID NO: 239110 - DNA, 27 bp, Artificial sequence
  SiRNA target sequence
ttcaatttatacatcaattgaacaatc

SEQ ID NO: 239111 - DNA, 27 bp, Artificial sequence
  SiRNA target sequence
tcaatttatacatcaattgaacaatct

SEQ ID NO: 239112 - DNA, 27 bp, Artificial sequence
  SiRNA target sequence
caatttatacatcaattgaacaatctg

SEQ ID NO: 239113 - DNA, 27 bp, Artificial sequence
  SiRNA target sequence
aatttatacatcaattgaacaatctgg

SEQ ID NO: 239114 - DNA, 27 bp, Artificial sequence
  SiRNA target sequence
atttatacatcaattgaacaatctgga

SEQ ID NO: 239115 - DNA, 27 bp, Artificial sequence
  SiRNA target sequence
tttatacatcaattgaacaatctggag

SEQ ID NO: 239116 - DNA, 27 bp, Artificial sequence
  SiRNA target sequence
ttatacatcaattgaacaatctggagt

SEQ ID NO: 239117 - DNA, 27 bp, Artificial sequence
  SiRNA target sequence
tatacatcaattgaacaatctggagtt

SEQ ID NO: 239118 - DNA, 27 bp, Artificial sequence
  SiRNA target sequence
atacatcaattgaacaatctggagttg

SEQ ID NO: 239119 - DNA, 27 bp, Artificial sequence
  SiRNA target sequence
tacatcaattgaacaatctggagttgc

SEQ ID NO: 239120 - DNA, 27 bp, Artificial sequence
  SiRNA target sequence
acatcaattgaacaatctggagttgct

SEQ ID NO: 239121 - DNA, 27 bp, Artificial sequence
  SiRNA target sequence
catcaattgaacaatctggagttgctg

SEQ ID NO: 239122 - DNA, 27 bp, Artificial sequence
  SiRNA target sequence
atcaattgaacaatctggagttgctgt

SEQ ID NO: 239123 - DNA, 27 bp, Artificial sequence
  SiRNA target sequence
tcaattgaacaatctggagttgctgtt

SEQ ID NO: 239124 - DNA, 27 bp, Artificial sequence
  SiRNA target sequence
caattgaacaatctggagttgctgtta

SEQ ID NO: 239125 - DNA, 27 bp, Artificial sequence
  SiRNA target sequence
aattgaacaatctggagttgctgttat

SEQ ID NO: 239126 - DNA, 27 bp, Artificial sequence
  SiRNA target sequence
attgaacaatctggagttgctgttatt

SEQ ID NO: 239127 - DNA, 27 bp, Artificial sequence
  SiRNA target sequence
ttgaacaatctggagttgctgttattg

SEQ ID NO: 239128 - DNA, 27 bp, Artificial sequence
  SiRNA target sequence
tgaacaatctggagttgctgttattgt

SEQ ID NO: 239129 - DNA, 27 bp, Artificial sequence
  SiRNA target sequence
gaacaatctggagttgctgttattgtc

SEQ ID NO: 239130 - DNA, 27 bp, Artificial sequence
  SiRNA target sequence
aacaatctggagttgctgttattgtca

SEQ ID NO: 239131 - DNA, 27 bp, Artificial sequence
  SiRNA target sequence
acaatctggagttgctgttattgtcat

SEQ ID NO: 239132 - DNA, 27 bp, Artificial sequence
  SiRNA target sequence
caatctggagttgctgttattgtcatg

SEQ ID NO: 239133 - DNA, 27 bp, Artificial sequence
  SiRNA target sequence
aatctggagttgctgttattgtcatga

SEQ ID NO: 239134 - DNA, 27 bp, Artificial sequence
  SiRNA target sequence
atctggagttgctgttattgtcatgat

SEQ ID NO: 239135 - DNA, 27 bp, Artificial sequence
  SiRNA target sequence
tctggagttgctgttattgtcatgatt

SEQ ID NO: 239136 - DNA, 27 bp, Artificial sequence
  SiRNA target sequence
ctggagttgctgttattgtcatgattt

SEQ ID NO: 239137 - DNA, 27 bp, Artificial sequence
  SiRNA target sequence
tggagttgctgttattgtcatgatttt

SEQ ID NO: 239138 - DNA, 27 bp, Artificial sequence
  SiRNA target sequence
ggagttgctgttattgtcatgattttg

SEQ ID NO: 239139 - DNA, 27 bp, Artificial sequence
  SiRNA target sequence
gagttgctgttattgtcatgattttgc

SEQ ID NO: 239140 - DNA, 27 bp, Artificial sequence
  SiRNA target sequence
agttgctgttattgtcatgattttgct

SEQ ID NO: 239141 - DNA, 27 bp, Artificial sequence
  SiRNA target sequence
gttgctgttattgtcatgattttgcta

SEQ ID NO: 239142 - DNA, 27 bp, Artificial sequence
  SiRNA target sequence
ttgctgttattgtcatgattttgctac

SEQ ID NO: 239143 - DNA, 27 bp, Artificial sequence
  SiRNA target sequence
tgctgttattgtcatgattttgctact

SEQ ID NO: 239144 - DNA, 27 bp, Artificial sequence
  SiRNA target sequence
gctgttattgtcatgattttgctactt

SEQ ID NO: 239145 - DNA, 27 bp, Artificial sequence
  SiRNA target sequence
ctgttattgtcatgattttgctactta

SEQ ID NO: 239146 - DNA, 27 bp, Artificial sequence
  SiRNA target sequence
tgttattgtcatgattttgctacttac

SEQ ID NO: 239147 - DNA, 27 bp, Artificial sequence
  SiRNA target sequence
gttattgtcatgattttgctacttacc

SEQ ID NO: 239148 - DNA, 27 bp, Artificial sequence
  SiRNA target sequence
ttattgtcatgattttgctacttaccc

SEQ ID NO: 239149 - DNA, 27 bp, Artificial sequence
  SiRNA target sequence
tattgtcatgattttgctacttacccc

SEQ ID NO: 239150 - DNA, 27 bp, Artificial sequence
  SiRNA target sequence
attgtcatgattttgctacttacccct

SEQ ID NO: 239151 - DNA, 27 bp, Artificial sequence
  SiRNA target sequence
ttgtcatgattttgctacttacccctt

SEQ ID NO: 239152 - DNA, 27 bp, Artificial sequence
  SiRNA target sequence
tgtcatgattttgctacttaccccttt

SEQ ID NO: 239153 - DNA, 27 bp, Artificial sequence
  SiRNA target sequence
gtcatgattttgctacttacccctttt

SEQ ID NO: 239154 - DNA, 27 bp, Artificial sequence
  SiRNA target sequence
tcatgattttgctacttaccccttttc

SEQ ID NO: 239155 - DNA, 27 bp, Artificial sequence
  SiRNA target sequence
catgattttgctacttaccccttttcc

SEQ ID NO: 239156 - DNA, 27 bp, Artificial sequence
  SiRNA target sequence
atgattttgctacttaccccttttcca

SEQ ID NO: 239157 - DNA, 27 bp, Artificial sequence
  SiRNA target sequence
tgattttgctacttaccccttttccaa

SEQ ID NO: 239158 - DNA, 27 bp, Artificial sequence
  SiRNA target sequence
gattttgctacttaccccttttccaag

SEQ ID NO: 239159 - DNA, 27 bp, Artificial sequence
  SiRNA target sequence
attttgctacttaccccttttccaagg

SEQ ID NO: 239160 - DNA, 27 bp, Artificial sequence
  SiRNA target sequence
ttttgctacttaccccttttccaaggc

SEQ ID NO: 239161 - DNA, 27 bp, Artificial sequence
  SiRNA target sequence
tttgctacttaccccttttccaaggct

SEQ ID NO: 239162 - DNA, 27 bp, Artificial sequence
  SiRNA target sequence
ttgctacttaccccttttccaaggctt

SEQ ID NO: 239163 - DNA, 27 bp, Artificial sequence
  SiRNA target sequence
tgctacttaccccttttccaaggctta

SEQ ID NO: 239164 - DNA, 27 bp, Artificial sequence
  SiRNA target sequence
gctacttaccccttttccaaggcttat

SEQ ID NO: 239165 - DNA, 27 bp, Artificial sequence
  SiRNA target sequence
ctacttaccccttttccaaggcttatt

SEQ ID NO: 239166 - DNA, 27 bp, Artificial sequence
  SiRNA target sequence
tacttaccccttttccaaggcttatta

SEQ ID NO: 239167 - DNA, 27 bp, Artificial sequence
  SiRNA target sequence
acttaccccttttccaaggcttattaa

SEQ ID NO: 239168 - DNA, 27 bp, Artificial sequence
  SiRNA target sequence
cttaccccttttccaaggcttattaaa

SEQ ID NO: 239169 - DNA, 27 bp, Artificial sequence
  SiRNA target sequence
ttaccccttttccaaggcttattaaaa

SEQ ID NO: 239170 - DNA, 27 bp, Artificial sequence
  SiRNA target sequence
taccccttttccaaggcttattaaaac

SEQ ID NO: 239171 - DNA, 27 bp, Artificial sequence
  SiRNA target sequence
accccttttccaaggcttattaaaaca

SEQ ID NO: 239172 - DNA, 27 bp, Artificial sequence
  SiRNA target sequence
ccccttttccaaggcttattaaaacaa

SEQ ID NO: 239173 - DNA, 27 bp, Artificial sequence
  SiRNA target sequence
cccttttccaaggcttattaaaacaaa

SEQ ID NO: 239174 - DNA, 27 bp, Artificial sequence
  SiRNA target sequence
ccttttccaaggcttattaaaacaaaa

SEQ ID NO: 239175 - DNA, 27 bp, Artificial sequence
  SiRNA target sequence
cttttccaaggcttattaaaacaaaag

SEQ ID NO: 239176 - DNA, 27 bp, Artificial sequence
  SiRNA target sequence
ttttccaaggcttattaaaacaaaagg

SEQ ID NO: 239177 - DNA, 27 bp, Artificial sequence
  SiRNA target sequence
tttccaaggcttattaaaacaaaagga

SEQ ID NO: 239178 - DNA, 27 bp, Artificial sequence
  SiRNA target sequence
ttccaaggcttattaaaacaaaaggat

SEQ ID NO: 239179 - DNA, 27 bp, Artificial sequence
  SiRNA target sequence
tccaaggcttattaaaacaaaaggatg

SEQ ID NO: 239180 - DNA, 27 bp, Artificial sequence
  SiRNA target sequence
ccaaggcttattaaaacaaaaggatgg

SEQ ID NO: 239181 - DNA, 27 bp, Artificial sequence
  SiRNA target sequence
caaggcttattaaaacaaaaggatgga

SEQ ID NO: 239182 - DNA, 27 bp, Artificial sequence
  SiRNA target sequence
aaggcttattaaaacaaaaggatggat

SEQ ID NO: 239183 - DNA, 27 bp, Artificial sequence
  SiRNA target sequence
aggcttattaaaacaaaaggatggatt

SEQ ID NO: 239184 - DNA, 27 bp, Artificial sequence
  SiRNA target sequence
ggcttattaaaacaaaaggatggatta

SEQ ID NO: 239185 - DNA, 27 bp, Artificial sequence
  SiRNA target sequence
gcttattaaaacaaaaggatggattac

SEQ ID NO: 239186 - DNA, 27 bp, Artificial sequence
  SiRNA target sequence
cttattaaaacaaaaggatggattaca

SEQ ID NO: 239187 - DNA, 27 bp, Artificial sequence
  SiRNA target sequence
ttattaaaacaaaaggatggattacaa

SEQ ID NO: 239188 - DNA, 27 bp, Artificial sequence
  SiRNA target sequence
tattaaaacaaaaggatggattacaat

SEQ ID NO: 239189 - DNA, 27 bp, Artificial sequence
  SiRNA target sequence
attaaaacaaaaggatggattacaata

SEQ ID NO: 239190 - DNA, 27 bp, Artificial sequence
  SiRNA target sequence
ttaaaacaaaaggatggattacaatag

SEQ ID NO: 239191 - DNA, 27 bp, Artificial sequence
  SiRNA target sequence
taaaacaaaaggatggattacaatagc

SEQ ID NO: 239192 - DNA, 27 bp, Artificial sequence
  SiRNA target sequence
aaaacaaaaggatggattacaatagcc

SEQ ID NO: 239193 - DNA, 27 bp, Artificial sequence
  SiRNA target sequence
aaacaaaaggatggattacaatagcca

SEQ ID NO: 239194 - DNA, 27 bp, Artificial sequence
  SiRNA target sequence
aacaaaaggatggattacaatagccat

SEQ ID NO: 239195 - DNA, 27 bp, Artificial sequence
  SiRNA target sequence
acaaaaggatggattacaatagccatt

SEQ ID NO: 239196 - DNA, 27 bp, Artificial sequence
  SiRNA target sequence
caaaaggatggattacaatagccattc

SEQ ID NO: 239197 - DNA, 27 bp, Artificial sequence
  SiRNA target sequence
aaaaggatggattacaatagccattct

SEQ ID NO: 239198 - DNA, 27 bp, Artificial sequence
  SiRNA target sequence
aaaggatggattacaatagccattcta

SEQ ID NO: 239199 - DNA, 27 bp, Artificial sequence
  SiRNA target sequence
aaggatggattacaatagccattctat

SEQ ID NO: 239200 - DNA, 27 bp, Artificial sequence
  SiRNA target sequence
aggatggattacaatagccattctatg

SEQ ID NO: 239201 - DNA, 27 bp, Artificial sequence
  SiRNA target sequence
ggatggattacaatagccattctatgt

SEQ ID NO: 239202 - DNA, 27 bp, Artificial sequence
  SiRNA target sequence
gatggattacaatagccattctatgtc

SEQ ID NO: 239203 - DNA, 27 bp, Artificial sequence
  SiRNA target sequence
atggattacaatagccattctatgtcc

SEQ ID NO: 239204 - DNA, 27 bp, Artificial sequence
  SiRNA target sequence
tggattacaatagccattctatgtcct

SEQ ID NO: 239205 - DNA, 27 bp, Artificial sequence
  SiRNA target sequence
ggattacaatagccattctatgtccta

SEQ ID NO: 239206 - DNA, 27 bp, Artificial sequence
  SiRNA target sequence
gattacaatagccattctatgtcctat

SEQ ID NO: 239207 - DNA, 27 bp, Artificial sequence
  SiRNA target sequence
attacaatagccattctatgtcctatt

SEQ ID NO: 239208 - DNA, 27 bp, Artificial sequence
  SiRNA target sequence
ttacaatagccattctatgtcctatta

SEQ ID NO: 239209 - DNA, 27 bp, Artificial sequence
  SiRNA target sequence
tacaatagccattctatgtcctattat

SEQ ID NO: 239210 - DNA, 27 bp, Artificial sequence
  SiRNA target sequence
acaatagccattctatgtcctattatt

SEQ ID NO: 239211 - DNA, 27 bp, Artificial sequence
  SiRNA target sequence
caatagccattctatgtcctattatta

SEQ ID NO: 239212 - DNA, 27 bp, Artificial sequence
  SiRNA target sequence
aatagccattctatgtcctattattac

SEQ ID NO: 239213 - DNA, 27 bp, Artificial sequence
  SiRNA target sequence
atagccattctatgtcctattattact

SEQ ID NO: 239214 - DNA, 27 bp, Artificial sequence
  SiRNA target sequence
tagccattctatgtcctattattactt

SEQ ID NO: 239215 - DNA, 27 bp, Artificial sequence
  SiRNA target sequence
agccattctatgtcctattattacttt

SEQ ID NO: 239216 - DNA, 27 bp, Artificial sequence
  SiRNA target sequence
gccattctatgtcctattattactttt

SEQ ID NO: 239217 - DNA, 27 bp, Artificial sequence
  SiRNA target sequence
ccattctatgtcctattattacttttt

SEQ ID NO: 239218 - DNA, 27 bp, Artificial sequence
  SiRNA target sequence
cattctatgtcctattattactttttt

SEQ ID NO: 239219 - DNA, 27 bp, Artificial sequence
  SiRNA target sequence
attctatgtcctattattacttttttt

SEQ ID NO: 239220 - DNA, 27 bp, Artificial sequence
  SiRNA target sequence
ttctatgtcctattattactttttttt

SEQ ID NO: 239221 - DNA, 27 bp, Artificial sequence
  SiRNA target sequence
tctatgtcctattattacttttttttc

SEQ ID NO: 239222 - DNA, 27 bp, Artificial sequence
  SiRNA target sequence
ctatgtcctattattacttttttttct

SEQ ID NO: 239223 - DNA, 27 bp, Artificial sequence
  SiRNA target sequence
tatgtcctattattacttttttttctg

SEQ ID NO: 239224 - DNA, 27 bp, Artificial sequence
  SiRNA target sequence
atgtcctattattacttttttttctgc

SEQ ID NO: 239225 - DNA, 27 bp, Artificial sequence
  SiRNA target sequence
tgtcctattattacttttttttctgct

SEQ ID NO: 239226 - DNA, 27 bp, Artificial sequence
  SiRNA target sequence
gtcctattattacttttttttctgctt

SEQ ID NO: 239227 - DNA, 27 bp, Artificial sequence
  SiRNA target sequence
tcctattattacttttttttctgcttt

SEQ ID NO: 239228 - DNA, 27 bp, Artificial sequence
  SiRNA target sequence
cctattattacttttttttctgctttt

SEQ ID NO: 239229 - DNA, 27 bp, Artificial sequence
  SiRNA target sequence
ctattattacttttttttctgcttttg

SEQ ID NO: 239230 - DNA, 27 bp, Artificial sequence
  SiRNA target sequence
tattattacttttttttctgcttttgg

SEQ ID NO: 239231 - DNA, 27 bp, Artificial sequence
  SiRNA target sequence
attattacttttttttctgcttttggt

SEQ ID NO: 239232 - DNA, 27 bp, Artificial sequence
  SiRNA target sequence
ttattacttttttttctgcttttggta

SEQ ID NO: 239233 - DNA, 27 bp, Artificial sequence
  SiRNA target sequence
tattacttttttttctgcttttggtac

SEQ ID NO: 239234 - DNA, 27 bp, Artificial sequence
  SiRNA target sequence
attacttttttttctgcttttggtact

SEQ ID NO: 239235 - DNA, 27 bp, Artificial sequence
  SiRNA target sequence
ttacttttttttctgcttttggtactt

SEQ ID NO: 239236 - DNA, 27 bp, Artificial sequence
  SiRNA target sequence
tacttttttttctgcttttggtacttt

SEQ ID NO: 239237 - DNA, 27 bp, Artificial sequence
  SiRNA target sequence
acttttttttctgcttttggtactttt

SEQ ID NO: 239238 - DNA, 27 bp, Artificial sequence
  SiRNA target sequence
cttttttttctgcttttggtacttttg

SEQ ID NO: 239239 - DNA, 27 bp, Artificial sequence
  SiRNA target sequence
ttttttttctgcttttggtacttttgt

SEQ ID NO: 239240 - DNA, 27 bp, Artificial sequence
  SiRNA target sequence
tttttttctgcttttggtacttttgta

SEQ ID NO: 239241 - DNA, 27 bp, Artificial sequence
  SiRNA target sequence
ttttttctgcttttggtacttttgtat

SEQ ID NO: 239242 - DNA, 27 bp, Artificial sequence
  SiRNA target sequence
tttttctgcttttggtacttttgtatt

SEQ ID NO: 239243 - DNA, 27 bp, Artificial sequence
  SiRNA target sequence
ttttctgcttttggtacttttgtatta

SEQ ID NO: 239244 - DNA, 27 bp, Artificial sequence
  SiRNA target sequence
tttctgcttttggtacttttgtattag

SEQ ID NO: 239245 - DNA, 27 bp, Artificial sequence
  SiRNA target sequence
ttctgcttttggtacttttgtattagc

SEQ ID NO: 239246 - DNA, 27 bp, Artificial sequence
  SiRNA target sequence
tctgcttttggtacttttgtattagct

SEQ ID NO: 239247 - DNA, 27 bp, Artificial sequence
  SiRNA target sequence
ctgcttttggtacttttgtattagctt

SEQ ID NO: 239248 - DNA, 27 bp, Artificial sequence
  SiRNA target sequence
tgcttttggtacttttgtattagctta

SEQ ID NO: 239249 - DNA, 27 bp, Artificial sequence
  SiRNA target sequence
gcttttggtacttttgtattagcttat

SEQ ID NO: 239250 - DNA, 27 bp, Artificial sequence
  SiRNA target sequence
cttttggtacttttgtattagcttatt

SEQ ID NO: 239251 - DNA, 27 bp, Artificial sequence
  SiRNA target sequence
ttttggtacttttgtattagcttattt

SEQ ID NO: 239252 - DNA, 27 bp, Artificial sequence
  SiRNA target sequence
tttggtacttttgtattagcttattta

SEQ ID NO: 239253 - DNA, 27 bp, Artificial sequence
  SiRNA target sequence
ttggtacttttgtattagcttatttaa

SEQ ID NO: 239254 - DNA, 27 bp, Artificial sequence
  SiRNA target sequence
tggtacttttgtattagcttatttaaa

SEQ ID NO: 239255 - DNA, 27 bp, Artificial sequence
  SiRNA target sequence
ggtacttttgtattagcttatttaaac

SEQ ID NO: 239256 - DNA, 27 bp, Artificial sequence
  SiRNA target sequence
gtacttttgtattagcttatttaaact

SEQ ID NO: 239257 - DNA, 27 bp, Artificial sequence
  SiRNA target sequence
tacttttgtattagcttatttaaactt

SEQ ID NO: 239258 - DNA, 27 bp, Artificial sequence
  SiRNA target sequence
acttttgtattagcttatttaaacttc

SEQ ID NO: 239259 - DNA, 27 bp, Artificial sequence
  SiRNA target sequence
cttttgtattagcttatttaaacttcc

SEQ ID NO: 239260 - DNA, 27 bp, Artificial sequence
  SiRNA target sequence
ttttgtattagcttatttaaacttccc

SEQ ID NO: 239261 - DNA, 27 bp, Artificial sequence
  SiRNA target sequence
tttgtattagcttatttaaacttccca

SEQ ID NO: 239262 - DNA, 27 bp, Artificial sequence
  SiRNA target sequence
ttgtattagcttatttaaacttcccaa

SEQ ID NO: 239263 - DNA, 27 bp, Artificial sequence
  SiRNA target sequence
tgtattagcttatttaaacttcccaat

SEQ ID NO: 239264 - DNA, 27 bp, Artificial sequence
  SiRNA target sequence
gtattagcttatttaaacttcccaatt

SEQ ID NO: 239265 - DNA, 27 bp, Artificial sequence
  SiRNA target sequence
tattagcttatttaaacttcccaatta

SEQ ID NO: 239266 - DNA, 27 bp, Artificial sequence
  SiRNA target sequence
attagcttatttaaacttcccaattac

SEQ ID NO: 239267 - DNA, 27 bp, Artificial sequence
  SiRNA target sequence
ttagcttatttaaacttcccaattaca

SEQ ID NO: 239268 - DNA, 27 bp, Artificial sequence
  SiRNA target sequence
tagcttatttaaacttcccaattacaa

SEQ ID NO: 239269 - DNA, 27 bp, Artificial sequence
  SiRNA target sequence
agcttatttaaacttcccaattacaaa

SEQ ID NO: 239270 - DNA, 27 bp, Artificial sequence
  SiRNA target sequence
gcttatttaaacttcccaattacaaac

SEQ ID NO: 239271 - DNA, 27 bp, Artificial sequence
  SiRNA target sequence
cttatttaaacttcccaattacaaaca

SEQ ID NO: 239272 - DNA, 27 bp, Artificial sequence
  SiRNA target sequence
ttatttaaacttcccaattacaaacaa

SEQ ID NO: 239273 - DNA, 27 bp, Artificial sequence
  SiRNA target sequence
tatttaaacttcccaattacaaacaaa

SEQ ID NO: 239274 - DNA, 27 bp, Artificial sequence
  SiRNA target sequence
atttaaacttcccaattacaaacaaag

SEQ ID NO: 239275 - DNA, 27 bp, Artificial sequence
  SiRNA target sequence
tttaaacttcccaattacaaacaaaga

SEQ ID NO: 239276 - DNA, 27 bp, Artificial sequence
  SiRNA target sequence
ttaaacttcccaattacaaacaaagag

SEQ ID NO: 239277 - DNA, 27 bp, Artificial sequence
  SiRNA target sequence
taaacttcccaattacaaacaaagagg

SEQ ID NO: 239278 - DNA, 27 bp, Artificial sequence
  SiRNA target sequence
aaacttcccaattacaaacaaagagga

SEQ ID NO: 239279 - DNA, 27 bp, Artificial sequence
  SiRNA target sequence
aacttcccaattacaaacaaagaggat

SEQ ID NO: 239280 - DNA, 27 bp, Artificial sequence
  SiRNA target sequence
acttcccaattacaaacaaagaggata

SEQ ID NO: 239281 - DNA, 27 bp, Artificial sequence
  SiRNA target sequence
cttcccaattacaaacaaagaggataa

SEQ ID NO: 239282 - DNA, 27 bp, Artificial sequence
  SiRNA target sequence
ttcccaattacaaacaaagaggataat

SEQ ID NO: 239283 - DNA, 27 bp, Artificial sequence
  SiRNA target sequence
tcccaattacaaacaaagaggataata

SEQ ID NO: 239284 - DNA, 27 bp, Artificial sequence
  SiRNA target sequence
cccaattacaaacaaagaggataatat

SEQ ID NO: 239285 - DNA, 27 bp, Artificial sequence
  SiRNA target sequence
ccaattacaaacaaagaggataatata

SEQ ID NO: 239286 - DNA, 27 bp, Artificial sequence
  SiRNA target sequence
caattacaaacaaagaggataatatat

SEQ ID NO: 239287 - DNA, 27 bp, Artificial sequence
  SiRNA target sequence
aattacaaacaaagaggataatatatt

SEQ ID NO: 239288 - DNA, 27 bp, Artificial sequence
  SiRNA target sequence
attacaaacaaagaggataatatattt

SEQ ID NO: 239289 - DNA, 27 bp, Artificial sequence
  SiRNA target sequence
ttacaaacaaagaggataatatatttg

SEQ ID NO: 239290 - DNA, 27 bp, Artificial sequence
  SiRNA target sequence
tacaaacaaagaggataatatatttga

SEQ ID NO: 239291 - DNA, 27 bp, Artificial sequence
  SiRNA target sequence
acaaacaaagaggataatatatttgat

SEQ ID NO: 239292 - DNA, 27 bp, Artificial sequence
  SiRNA target sequence
caaacaaagaggataatatatttgata

SEQ ID NO: 239293 - DNA, 27 bp, Artificial sequence
  SiRNA target sequence
aaacaaagaggataatatatttgatat

SEQ ID NO: 239294 - DNA, 27 bp, Artificial sequence
  SiRNA target sequence
aacaaagaggataatatatttgatatt

SEQ ID NO: 239295 - DNA, 27 bp, Artificial sequence
  SiRNA target sequence
acaaagaggataatatatttgatattt

SEQ ID NO: 239296 - DNA, 27 bp, Artificial sequence
  SiRNA target sequence
caaagaggataatatatttgatattta

SEQ ID NO: 239297 - DNA, 27 bp, Artificial sequence
  SiRNA target sequence
aaagaggataatatatttgatatttac

SEQ ID NO: 239298 - DNA, 27 bp, Artificial sequence
  SiRNA target sequence
aagaggataatatatttgatatttacc

SEQ ID NO: 239299 - DNA, 27 bp, Artificial sequence
  SiRNA target sequence
agaggataatatatttgatatttaccg

SEQ ID NO: 239300 - DNA, 27 bp, Artificial sequence
  SiRNA target sequence
gaggataatatatttgatatttaccgt

SEQ ID NO: 239301 - DNA, 27 bp, Artificial sequence
  SiRNA target sequence
aggataatatatttgatatttaccgtt

SEQ ID NO: 239302 - DNA, 27 bp, Artificial sequence
  SiRNA target sequence
ggataatatatttgatatttaccgttt

SEQ ID NO: 239303 - DNA, 27 bp, Artificial sequence
  SiRNA target sequence
gataatatatttgatatttaccgttta

SEQ ID NO: 239304 - DNA, 27 bp, Artificial sequence
  SiRNA target sequence
ataatatatttgatatttaccgtttac

SEQ ID NO: 239305 - DNA, 27 bp, Artificial sequence
  SiRNA target sequence
taatatatttgatatttaccgtttacc

SEQ ID NO: 239306 - DNA, 27 bp, Artificial sequence
  SiRNA target sequence
aatatatttgatatttaccgtttaccg

SEQ ID NO: 239307 - DNA, 27 bp, Artificial sequence
  SiRNA target sequence
atatatttgatatttaccgtttaccgt

SEQ ID NO: 239308 - DNA, 27 bp, Artificial sequence
  SiRNA target sequence
tatatttgatatttaccgtttaccgtc

SEQ ID NO: 239309 - DNA, 27 bp, Artificial sequence
  SiRNA target sequence
atatttgatatttaccgtttaccgtca

SEQ ID NO: 239310 - DNA, 27 bp, Artificial sequence
  SiRNA target sequence
tatttgatatttaccgtttaccgtcaa

SEQ ID NO: 239311 - DNA, 27 bp, Artificial sequence
  SiRNA target sequence
atttgatatttaccgtttaccgtcaac

SEQ ID NO: 239312 - DNA, 27 bp, Artificial sequence
  SiRNA target sequence
tttgatatttaccgtttaccgtcaact

SEQ ID NO: 239313 - DNA, 27 bp, Artificial sequence
  SiRNA target sequence
ttgatatttaccgtttaccgtcaactg

SEQ ID NO: 239314 - DNA, 27 bp, Artificial sequence
  SiRNA target sequence
tgatatttaccgtttaccgtcaactga

SEQ ID NO: 239315 - DNA, 27 bp, Artificial sequence
  SiRNA target sequence
gatatttaccgtttaccgtcaactgat

SEQ ID NO: 239316 - DNA, 27 bp, Artificial sequence
  SiRNA target sequence
atatttaccgtttaccgtcaactgatt

SEQ ID NO: 239317 - DNA, 27 bp, Artificial sequence
  SiRNA target sequence
tatttaccgtttaccgtcaactgattc

SEQ ID NO: 239318 - DNA, 27 bp, Artificial sequence
  SiRNA target sequence
atttaccgtttaccgtcaactgattct

SEQ ID NO: 239319 - DNA, 27 bp, Artificial sequence
  SiRNA target sequence
tttaccgtttaccgtcaactgattcta

SEQ ID NO: 239320 - DNA, 27 bp, Artificial sequence
  SiRNA target sequence
ttaccgtttaccgtcaactgattctat

SEQ ID NO: 239321 - DNA, 27 bp, Artificial sequence
  SiRNA target sequence
taccgtttaccgtcaactgattctata

SEQ ID NO: 239322 - DNA, 27 bp, Artificial sequence
  SiRNA target sequence
accgtttaccgtcaactgattctataa

SEQ ID NO: 239323 - DNA, 27 bp, Artificial sequence
  SiRNA target sequence
ccgtttaccgtcaactgattctataat

SEQ ID NO: 239324 - DNA, 27 bp, Artificial sequence
  SiRNA target sequence
cgtttaccgtcaactgattctataatc

SEQ ID NO: 239325 - DNA, 27 bp, Artificial sequence
  SiRNA target sequence
gtttaccgtcaactgattctataatca

SEQ ID NO: 239326 - DNA, 27 bp, Artificial sequence
  SiRNA target sequence
tttaccgtcaactgattctataatcaa

SEQ ID NO: 239327 - DNA, 27 bp, Artificial sequence
  SiRNA target sequence
ttaccgtcaactgattctataatcaaa

SEQ ID NO: 239328 - DNA, 27 bp, Artificial sequence
  SiRNA target sequence
taccgtcaactgattctataatcaaat

SEQ ID NO: 239329 - DNA, 27 bp, Artificial sequence
  SiRNA target sequence
accgtcaactgattctataatcaaatt

SEQ ID NO: 239330 - DNA, 27 bp, Artificial sequence
  SiRNA target sequence
ccgtcaactgattctataatcaaatta

SEQ ID NO: 239331 - DNA, 27 bp, Artificial sequence
  SiRNA target sequence
cgtcaactgattctataatcaaattag

SEQ ID NO: 239332 - DNA, 27 bp, Artificial sequence
  SiRNA target sequence
gtcaactgattctataatcaaattaga

SEQ ID NO: 239333 - DNA, 27 bp, Artificial sequence
  SiRNA target sequence
tcaactgattctataatcaaattagaa

SEQ ID NO: 239334 - DNA, 27 bp, Artificial sequence
  SiRNA target sequence
caactgattctataatcaaattagaaa

SEQ ID NO: 239335 - DNA, 27 bp, Artificial sequence
  SiRNA target sequence
aactgattctataatcaaattagaaaa

SEQ ID NO: 239336 - DNA, 27 bp, Artificial sequence
  SiRNA target sequence
actgattctataatcaaattagaaaat

SEQ ID NO: 239337 - DNA, 27 bp, Artificial sequence
  SiRNA target sequence
ctgattctataatcaaattagaaaata

SEQ ID NO: 239338 - DNA, 27 bp, Artificial sequence
  SiRNA target sequence
tgattctataatcaaattagaaaatat

SEQ ID NO: 239339 - DNA, 27 bp, Artificial sequence
  SiRNA target sequence
gattctataatcaaattagaaaatatt

SEQ ID NO: 239340 - DNA, 27 bp, Artificial sequence
  SiRNA target sequence
attctataatcaaattagaaaatattg

SEQ ID NO: 239341 - DNA, 27 bp, Artificial sequence
  SiRNA target sequence
ttctataatcaaattagaaaatattgt

SEQ ID NO: 239342 - DNA, 27 bp, Artificial sequence
  SiRNA target sequence
tctataatcaaattagaaaatattgtt

SEQ ID NO: 239343 - DNA, 27 bp, Artificial sequence
  SiRNA target sequence
ctataatcaaattagaaaatattgttg

SEQ ID NO: 239344 - DNA, 27 bp, Artificial sequence
  SiRNA target sequence
tataatcaaattagaaaatattgttgg

SEQ ID NO: 239345 - DNA, 27 bp, Artificial sequence
  SiRNA target sequence
ataatcaaattagaaaatattgttggt

SEQ ID NO: 239346 - DNA, 27 bp, Artificial sequence
  SiRNA target sequence
taatcaaattagaaaatattgttggtg

SEQ ID NO: 239347 - DNA, 27 bp, Artificial sequence
  SiRNA target sequence
aatcaaattagaaaatattgttggtgt

SEQ ID NO: 239348 - DNA, 27 bp, Artificial sequence
  SiRNA target sequence
atcaaattagaaaatattgttggtgtc

SEQ ID NO: 239349 - DNA, 27 bp, Artificial sequence
  SiRNA target sequence
tcaaattagaaaatattgttggtgtca

SEQ ID NO: 239350 - DNA, 27 bp, Artificial sequence
  SiRNA target sequence
caaattagaaaatattgttggtgtcat

SEQ ID NO: 239351 - DNA, 27 bp, Artificial sequence
  SiRNA target sequence
aaattagaaaatattgttggtgtcatt

SEQ ID NO: 239352 - DNA, 27 bp, Artificial sequence
  SiRNA target sequence
aattagaaaatattgttggtgtcattt

SEQ ID NO: 239353 - DNA, 27 bp, Artificial sequence
  SiRNA target sequence
attagaaaatattgttggtgtcatttg

SEQ ID NO: 239354 - DNA, 27 bp, Artificial sequence
  SiRNA target sequence
ttagaaaatattgttggtgtcatttgt

SEQ ID NO: 239355 - DNA, 27 bp, Artificial sequence
  SiRNA target sequence
tagaaaatattgttggtgtcatttgtg

SEQ ID NO: 239356 - DNA, 27 bp, Artificial sequence
  SiRNA target sequence
agaaaatattgttggtgtcatttgtgt

SEQ ID NO: 239357 - DNA, 27 bp, Artificial sequence
  SiRNA target sequence
gaaaatattgttggtgtcatttgtgta

SEQ ID NO: 239358 - DNA, 27 bp, Artificial sequence
  SiRNA target sequence
aaaatattgttggtgtcatttgtgtat

SEQ ID NO: 239359 - DNA, 27 bp, Artificial sequence
  SiRNA target sequence
aaatattgttggtgtcatttgtgtatc

SEQ ID NO: 239360 - DNA, 27 bp, Artificial sequence
  SiRNA target sequence
aatattgttggtgtcatttgtgtatct

SEQ ID NO: 239361 - DNA, 27 bp, Artificial sequence
  SiRNA target sequence
atattgttggtgtcatttgtgtatctt

SEQ ID NO: 239362 - DNA, 27 bp, Artificial sequence
  SiRNA target sequence
tattgttggtgtcatttgtgtatcttt

SEQ ID NO: 239363 - DNA, 27 bp, Artificial sequence
  SiRNA target sequence
attgttggtgtcatttgtgtatcttta

SEQ ID NO: 239364 - DNA, 27 bp, Artificial sequence
  SiRNA target sequence
ttgttggtgtcatttgtgtatctttaa

SEQ ID NO: 239365 - DNA, 27 bp, Artificial sequence
  SiRNA target sequence
tgttggtgtcatttgtgtatctttaat

SEQ ID NO: 239366 - DNA, 27 bp, Artificial sequence
  SiRNA target sequence
gttggtgtcatttgtgtatctttaatg

SEQ ID NO: 239367 - DNA, 27 bp, Artificial sequence
  SiRNA target sequence
ttggtgtcatttgtgtatctttaatga

SEQ ID NO: 239368 - DNA, 27 bp, Artificial sequence
  SiRNA target sequence
tggtgtcatttgtgtatctttaatgaa

SEQ ID NO: 239369 - DNA, 27 bp, Artificial sequence
  SiRNA target sequence
ggtgtcatttgtgtatctttaatgaag

SEQ ID NO: 239370 - DNA, 27 bp, Artificial sequence
  SiRNA target sequence
gtgtcatttgtgtatctttaatgaaga

SEQ ID NO: 239371 - DNA, 27 bp, Artificial sequence
  SiRNA target sequence
tgtcatttgtgtatctttaatgaagat

SEQ ID NO: 239372 - DNA, 27 bp, Artificial sequence
  SiRNA target sequence
gtcatttgtgtatctttaatgaagatt

SEQ ID NO: 239373 - DNA, 27 bp, Artificial sequence
  SiRNA target sequence
tcatttgtgtatctttaatgaagattt

SEQ ID NO: 239374 - DNA, 27 bp, Artificial sequence
  SiRNA target sequence
catttgtgtatctttaatgaagatttc

SEQ ID NO: 239375 - DNA, 27 bp, Artificial sequence
  SiRNA target sequence
atttgtgtatctttaatgaagatttct

SEQ ID NO: 239376 - DNA, 27 bp, Artificial sequence
  SiRNA target sequence
tttgtgtatctttaatgaagatttcta

SEQ ID NO: 239377 - DNA, 27 bp, Artificial sequence
  SiRNA target sequence
ttgtgtatctttaatgaagatttctaa

SEQ ID NO: 239378 - DNA, 27 bp, Artificial sequence
  SiRNA target sequence
tgtgtatctttaatgaagatttctaaa

SEQ ID NO: 239379 - DNA, 27 bp, Artificial sequence
  SiRNA target sequence
gtgtatctttaatgaagatttctaaat

SEQ ID NO: 239380 - DNA, 27 bp, Artificial sequence
  SiRNA target sequence
tgtatctttaatgaagatttctaaata

SEQ ID NO: 239381 - DNA, 27 bp, Artificial sequence
  SiRNA target sequence
gtatctttaatgaagatttctaaatat

SEQ ID NO: 239382 - DNA, 27 bp, Artificial sequence
  SiRNA target sequence
tatctttaatgaagatttctaaatatg

SEQ ID NO: 239383 - DNA, 27 bp, Artificial sequence
  SiRNA target sequence
atctttaatgaagatttctaaatatgc

SEQ ID NO: 239384 - DNA, 27 bp, Artificial sequence
  SiRNA target sequence
tctttaatgaagatttctaaatatgca

SEQ ID NO: 239385 - DNA, 27 bp, Artificial sequence
  SiRNA target sequence
ctttaatgaagatttctaaatatgcag

SEQ ID NO: 239386 - DNA, 27 bp, Artificial sequence
  SiRNA target sequence
tttaatgaagatttctaaatatgcagc

SEQ ID NO: 239387 - DNA, 27 bp, Artificial sequence
  SiRNA target sequence
ttaatgaagatttctaaatatgcagca

SEQ ID NO: 239388 - DNA, 27 bp, Artificial sequence
  SiRNA target sequence
taatgaagatttctaaatatgcagcat

SEQ ID NO: 239389 - DNA, 27 bp, Artificial sequence
  SiRNA target sequence
aatgaagatttctaaatatgcagcatt

SEQ ID NO: 239390 - DNA, 27 bp, Artificial sequence
  SiRNA target sequence
atgaagatttctaaatatgcagcattt

SEQ ID NO: 239391 - DNA, 27 bp, Artificial sequence
  SiRNA target sequence
tgaagatttctaaatatgcagcatttg

SEQ ID NO: 239392 - DNA, 27 bp, Artificial sequence
  SiRNA target sequence
gaagatttctaaatatgcagcatttga

SEQ ID NO: 239393 - DNA, 27 bp, Artificial sequence
  SiRNA target sequence
aagatttctaaatatgcagcatttgat

SEQ ID NO: 239394 - DNA, 27 bp, Artificial sequence
  SiRNA target sequence
agatttctaaatatgcagcatttgata

SEQ ID NO: 239395 - DNA, 27 bp, Artificial sequence
  SiRNA target sequence
gatttctaaatatgcagcatttgatat

SEQ ID NO: 239396 - DNA, 27 bp, Artificial sequence
  SiRNA target sequence
atttctaaatatgcagcatttgatatc

SEQ ID NO: 239397 - DNA, 27 bp, Artificial sequence
  SiRNA target sequence
tttctaaatatgcagcatttgatatca

SEQ ID NO: 239398 - DNA, 27 bp, Artificial sequence
  SiRNA target sequence
ttctaaatatgcagcatttgatatcac

SEQ ID NO: 239399 - DNA, 27 bp, Artificial sequence
  SiRNA target sequence
tctaaatatgcagcatttgatatcaca

SEQ ID NO: 239400 - DNA, 27 bp, Artificial sequence
  SiRNA target sequence
ctaaatatgcagcatttgatatcacaa

SEQ ID NO: 239401 - DNA, 27 bp, Artificial sequence
  SiRNA target sequence
taaatatgcagcatttgatatcacaaa

SEQ ID NO: 239402 - DNA, 27 bp, Artificial sequence
  SiRNA target sequence
aaatatgcagcatttgatatcacaaaa

SEQ ID NO: 239403 - DNA, 27 bp, Artificial sequence
  SiRNA target sequence
aatatgcagcatttgatatcacaaaag

SEQ ID NO: 239404 - DNA, 27 bp, Artificial sequence
  SiRNA target sequence
atatgcagcatttgatatcacaaaaga

SEQ ID NO: 239405 - DNA, 27 bp, Artificial sequence
  SiRNA target sequence
tatgcagcatttgatatcacaaaagag

SEQ ID NO: 239406 - DNA, 27 bp, Artificial sequence
  SiRNA target sequence
atgcagcatttgatatcacaaaagagg

SEQ ID NO: 239407 - DNA, 27 bp, Artificial sequence
  SiRNA target sequence
tgcagcatttgatatcacaaaagaggc

SEQ ID NO: 239408 - DNA, 27 bp, Artificial sequence
  SiRNA target sequence
gcagcatttgatatcacaaaagaggct

SEQ ID NO: 239409 - DNA, 27 bp, Artificial sequence
  SiRNA target sequence
cagcatttgatatcacaaaagaggctt

SEQ ID NO: 239410 - DNA, 27 bp, Artificial sequence
  SiRNA target sequence
agcatttgatatcacaaaagaggcttt

SEQ ID NO: 239411 - DNA, 27 bp, Artificial sequence
  SiRNA target sequence
gcatttgatatcacaaaagaggctttg

SEQ ID NO: 239412 - DNA, 27 bp, Artificial sequence
  SiRNA target sequence
catttgatatcacaaaagaggctttgt

SEQ ID NO: 239413 - DNA, 27 bp, Artificial sequence
  SiRNA target sequence
atttgatatcacaaaagaggctttgtc

SEQ ID NO: 239414 - DNA, 27 bp, Artificial sequence
  SiRNA target sequence
tttgatatcacaaaagaggctttgtct

SEQ ID NO: 239415 - DNA, 27 bp, Artificial sequence
  SiRNA target sequence
ttgatatcacaaaagaggctttgtcta

SEQ ID NO: 239416 - DNA, 27 bp, Artificial sequence
  SiRNA target sequence
tgatatcacaaaagaggctttgtctat

SEQ ID NO: 239417 - DNA, 27 bp, Artificial sequence
  SiRNA target sequence
gatatcacaaaagaggctttgtctatg

SEQ ID NO: 239418 - DNA, 27 bp, Artificial sequence
  SiRNA target sequence
atatcacaaaagaggctttgtctatgc

SEQ ID NO: 239419 - DNA, 27 bp, Artificial sequence
  SiRNA target sequence
tatcacaaaagaggctttgtctatgca

SEQ ID NO: 239420 - DNA, 27 bp, Artificial sequence
  SiRNA target sequence
atcacaaaagaggctttgtctatgcag

SEQ ID NO: 239421 - DNA, 27 bp, Artificial sequence
  SiRNA target sequence
tcacaaaagaggctttgtctatgcaga

SEQ ID NO: 239422 - DNA, 27 bp, Artificial sequence
  SiRNA target sequence
cacaaaagaggctttgtctatgcagat

SEQ ID NO: 239423 - DNA, 27 bp, Artificial sequence
  SiRNA target sequence
acaaaagaggctttgtctatgcagatt

SEQ ID NO: 239424 - DNA, 27 bp, Artificial sequence
  SiRNA target sequence
caaaagaggctttgtctatgcagattg

SEQ ID NO: 239425 - DNA, 27 bp, Artificial sequence
  SiRNA target sequence
aaaagaggctttgtctatgcagattga

SEQ ID NO: 239426 - DNA, 27 bp, Artificial sequence
  SiRNA target sequence
aaagaggctttgtctatgcagattgat

SEQ ID NO: 239427 - DNA, 27 bp, Artificial sequence
  SiRNA target sequence
aagaggctttgtctatgcagattgatg

SEQ ID NO: 239428 - DNA, 27 bp, Artificial sequence
  SiRNA target sequence
agaggctttgtctatgcagattgatgg

SEQ ID NO: 239429 - DNA, 27 bp, Artificial sequence
  SiRNA target sequence
gaggctttgtctatgcagattgatggt

SEQ ID NO: 239430 - DNA, 27 bp, Artificial sequence
  SiRNA target sequence
aggctttgtctatgcagattgatggtt

SEQ ID NO: 239431 - DNA, 27 bp, Artificial sequence
  SiRNA target sequence
ggctttgtctatgcagattgatggttc

SEQ ID NO: 239432 - DNA, 27 bp, Artificial sequence
  SiRNA target sequence
gctttgtctatgcagattgatggttct

SEQ ID NO: 239433 - DNA, 27 bp, Artificial sequence
  SiRNA target sequence
ctttgtctatgcagattgatggttcta

SEQ ID NO: 239434 - DNA, 27 bp, Artificial sequence
  SiRNA target sequence
tttgtctatgcagattgatggttctat

SEQ ID NO: 239435 - DNA, 27 bp, Artificial sequence
  SiRNA target sequence
ttgtctatgcagattgatggttctata

SEQ ID NO: 239436 - DNA, 27 bp, Artificial sequence
  SiRNA target sequence
tgtctatgcagattgatggttctataa

SEQ ID NO: 239437 - DNA, 27 bp, Artificial sequence
  SiRNA target sequence
gtctatgcagattgatggttctataag

SEQ ID NO: 239438 - DNA, 27 bp, Artificial sequence
  SiRNA target sequence
tctatgcagattgatggttctataaga

SEQ ID NO: 239439 - DNA, 27 bp, Artificial sequence
  SiRNA target sequence
ctatgcagattgatggttctataagag

SEQ ID NO: 239440 - DNA, 27 bp, Artificial sequence
  SiRNA target sequence
tatgcagattgatggttctataagagc

SEQ ID NO: 239441 - DNA, 27 bp, Artificial sequence
  SiRNA target sequence
atgcagattgatggttctataagagcg

SEQ ID NO: 239442 - DNA, 27 bp, Artificial sequence
  SiRNA target sequence
tgcagattgatggttctataagagcga

SEQ ID NO: 239443 - DNA, 27 bp, Artificial sequence
  SiRNA target sequence
gcagattgatggttctataagagcgaa

SEQ ID NO: 239444 - DNA, 27 bp, Artificial sequence
  SiRNA target sequence
cagattgatggttctataagagcgaaa

SEQ ID NO: 239445 - DNA, 27 bp, Artificial sequence
  SiRNA target sequence
agattgatggttctataagagcgaaat

SEQ ID NO: 239446 - DNA, 27 bp, Artificial sequence
  SiRNA target sequence
gattgatggttctataagagcgaaata

SEQ ID NO: 239447 - DNA, 27 bp, Artificial sequence
  SiRNA target sequence
attgatggttctataagagcgaaatac

SEQ ID NO: 239448 - DNA, 27 bp, Artificial sequence
  SiRNA target sequence
ttgatggttctataagagcgaaataca

SEQ ID NO: 239449 - DNA, 27 bp, Artificial sequence
  SiRNA target sequence
tgatggttctataagagcgaaatacaa

SEQ ID NO: 239450 - DNA, 27 bp, Artificial sequence
  SiRNA target sequence
gatggttctataagagcgaaatacaaa

SEQ ID NO: 239451 - DNA, 27 bp, Artificial sequence
  SiRNA target sequence
atggttctataagagcgaaatacaaag

SEQ ID NO: 239452 - DNA, 27 bp, Artificial sequence
  SiRNA target sequence
tggttctataagagcgaaatacaaagg

SEQ ID NO: 239453 - DNA, 27 bp, Artificial sequence
  SiRNA target sequence
ggttctataagagcgaaatacaaaggt

SEQ ID NO: 239454 - DNA, 27 bp, Artificial sequence
  SiRNA target sequence
gttctataagagcgaaatacaaaggta

SEQ ID NO: 239455 - DNA, 27 bp, Artificial sequence
  SiRNA target sequence
ttctataagagcgaaatacaaaggtat

SEQ ID NO: 239456 - DNA, 27 bp, Artificial sequence
  SiRNA target sequence
tctataagagcgaaatacaaaggtatt

SEQ ID NO: 239457 - DNA, 27 bp, Artificial sequence
  SiRNA target sequence
ctataagagcgaaatacaaaggtattt

SEQ ID NO: 239458 - DNA, 27 bp, Artificial sequence
  SiRNA target sequence
tataagagcgaaatacaaaggtatttt

SEQ ID NO: 239459 - DNA, 27 bp, Artificial sequence
  SiRNA target sequence
ataagagcgaaatacaaaggtattttt

SEQ ID NO: 239460 - DNA, 27 bp, Artificial sequence
  SiRNA target sequence
taagagcgaaatacaaaggtatttttg

SEQ ID NO: 239461 - DNA, 27 bp, Artificial sequence
  SiRNA target sequence
aagagcgaaatacaaaggtatttttga

SEQ ID NO: 239462 - DNA, 27 bp, Artificial sequence
  SiRNA target sequence
agagcgaaatacaaaggtatttttgat

SEQ ID NO: 239463 - DNA, 27 bp, Artificial sequence
  SiRNA target sequence
gagcgaaatacaaaggtatttttgatg

SEQ ID NO: 239464 - DNA, 27 bp, Artificial sequence
  SiRNA target sequence
agcgaaatacaaaggtatttttgatgg

SEQ ID NO: 239465 - DNA, 27 bp, Artificial sequence
  SiRNA target sequence
gcgaaatacaaaggtatttttgatggt

SEQ ID NO: 239466 - DNA, 27 bp, Artificial sequence
  SiRNA target sequence
cgaaatacaaaggtatttttgatggtg

SEQ ID NO: 239467 - DNA, 27 bp, Artificial sequence
  SiRNA target sequence
gaaatacaaaggtatttttgatggtgt

SEQ ID NO: 239468 - DNA, 27 bp, Artificial sequence
  SiRNA target sequence
aaatacaaaggtatttttgatggtgta

SEQ ID NO: 239469 - DNA, 27 bp, Artificial sequence
  SiRNA target sequence
aatacaaaggtatttttgatggtgtat

SEQ ID NO: 239470 - DNA, 27 bp, Artificial sequence
  SiRNA target sequence
atacaaaggtatttttgatggtgtatt

SEQ ID NO: 239471 - DNA, 27 bp, Artificial sequence
  SiRNA target sequence
tacaaaggtatttttgatggtgtattt

SEQ ID NO: 239472 - DNA, 27 bp, Artificial sequence
  SiRNA target sequence
acaaaggtatttttgatggtgtatttg

SEQ ID NO: 239473 - DNA, 27 bp, Artificial sequence
  SiRNA target sequence
caaaggtatttttgatggtgtatttgg

SEQ ID NO: 239474 - DNA, 27 bp, Artificial sequence
  SiRNA target sequence
aaaggtatttttgatggtgtatttggt

SEQ ID NO: 239475 - DNA, 27 bp, Artificial sequence
  SiRNA target sequence
aaggtatttttgatggtgtatttggta

SEQ ID NO: 239476 - DNA, 27 bp, Artificial sequence
  SiRNA target sequence
aggtatttttgatggtgtatttggtaa

SEQ ID NO: 239477 - DNA, 27 bp, Artificial sequence
  SiRNA target sequence
ggtatttttgatggtgtatttggtaag

SEQ ID NO: 239478 - DNA, 27 bp, Artificial sequence
  SiRNA target sequence
gtatttttgatggtgtatttggtaagc

SEQ ID NO: 239479 - DNA, 27 bp, Artificial sequence
  SiRNA target sequence
tatttttgatggtgtatttggtaagct

SEQ ID NO: 239480 - DNA, 27 bp, Artificial sequence
  SiRNA target sequence
atttttgatggtgtatttggtaagctg

SEQ ID NO: 239481 - DNA, 27 bp, Artificial sequence
  SiRNA target sequence
tttttgatggtgtatttggtaagctgg

SEQ ID NO: 239482 - DNA, 27 bp, Artificial sequence
  SiRNA target sequence
ttttgatggtgtatttggtaagctggg

SEQ ID NO: 239483 - DNA, 27 bp, Artificial sequence
  SiRNA target sequence
tttgatggtgtatttggtaagctgggg

SEQ ID NO: 239484 - DNA, 27 bp, Artificial sequence
  SiRNA target sequence
ttgatggtgtatttggtaagctgggga

SEQ ID NO: 239485 - DNA, 27 bp, Artificial sequence
  SiRNA target sequence
tgatggtgtatttggtaagctggggaa

SEQ ID NO: 239486 - DNA, 27 bp, Artificial sequence
  SiRNA target sequence
gatggtgtatttggtaagctggggaaa

SEQ ID NO: 239487 - DNA, 27 bp, Artificial sequence
  SiRNA target sequence
atggtgtatttggtaagctggggaaat

SEQ ID NO: 239488 - DNA, 27 bp, Artificial sequence
  SiRNA target sequence
tggtgtatttggtaagctggggaaatc

SEQ ID NO: 239489 - DNA, 27 bp, Artificial sequence
  SiRNA target sequence
ggtgtatttggtaagctggggaaatct

SEQ ID NO: 239490 - DNA, 27 bp, Artificial sequence
  SiRNA target sequence
gtgtatttggtaagctggggaaatctt

SEQ ID NO: 239491 - DNA, 27 bp, Artificial sequence
  SiRNA target sequence
tgtatttggtaagctggggaaatcttt

SEQ ID NO: 239492 - DNA, 27 bp, Artificial sequence
  SiRNA target sequence
gtatttggtaagctggggaaatctttt

SEQ ID NO: 239493 - DNA, 27 bp, Artificial sequence
  SiRNA target sequence
tatttggtaagctggggaaatcttttg

SEQ ID NO: 239494 - DNA, 27 bp, Artificial sequence
  SiRNA target sequence
atttggtaagctggggaaatcttttgg

SEQ ID NO: 239495 - DNA, 27 bp, Artificial sequence
  SiRNA target sequence
tttggtaagctggggaaatcttttgga

SEQ ID NO: 239496 - DNA, 27 bp, Artificial sequence
  SiRNA target sequence
ttggtaagctggggaaatcttttggat

SEQ ID NO: 239497 - DNA, 27 bp, Artificial sequence
  SiRNA target sequence
tggtaagctggggaaatcttttggatc

SEQ ID NO: 239498 - DNA, 27 bp, Artificial sequence
  SiRNA target sequence
ggtaagctggggaaatcttttggatca

SEQ ID NO: 239499 - DNA, 27 bp, Artificial sequence
  SiRNA target sequence
gtaagctggggaaatcttttggatcag

SEQ ID NO: 239500 - DNA, 27 bp, Artificial sequence
  SiRNA target sequence
taagctggggaaatcttttggatcagt

SEQ ID NO: 239501 - DNA, 27 bp, Artificial sequence
  SiRNA target sequence
aagctggggaaatcttttggatcagtt

SEQ ID NO: 239502 - DNA, 27 bp, Artificial sequence
  SiRNA target sequence
agctggggaaatcttttggatcagttt

SEQ ID NO: 239503 - DNA, 27 bp, Artificial sequence
  SiRNA target sequence
gctggggaaatcttttggatcagttta

SEQ ID NO: 239504 - DNA, 27 bp, Artificial sequence
  SiRNA target sequence
ctggggaaatcttttggatcagtttat

SEQ ID NO: 239505 - DNA, 27 bp, Artificial sequence
  SiRNA target sequence
tggggaaatcttttggatcagtttatg

SEQ ID NO: 239506 - DNA, 27 bp, Artificial sequence
  SiRNA target sequence
ggggaaatcttttggatcagtttatgg

SEQ ID NO: 239507 - DNA, 27 bp, Artificial sequence
  SiRNA target sequence
gggaaatcttttggatcagtttatgga

SEQ ID NO: 239508 - DNA, 27 bp, Artificial sequence
  SiRNA target sequence
ggaaatcttttggatcagtttatggat

SEQ ID NO: 239509 - DNA, 27 bp, Artificial sequence
  SiRNA target sequence
gaaatcttttggatcagtttatggatt

SEQ ID NO: 239510 - DNA, 27 bp, Artificial sequence
  SiRNA target sequence
aaatcttttggatcagtttatggattt

SEQ ID NO: 239511 - DNA, 27 bp, Artificial sequence
  SiRNA target sequence
aatcttttggatcagtttatggattta

SEQ ID NO: 239512 - DNA, 27 bp, Artificial sequence
  SiRNA target sequence
atcttttggatcagtttatggatttac

SEQ ID NO: 239513 - DNA, 27 bp, Artificial sequence
  SiRNA target sequence
tcttttggatcagtttatggatttaca

SEQ ID NO: 239514 - DNA, 27 bp, Artificial sequence
  SiRNA target sequence
cttttggatcagtttatggatttacaa

SEQ ID NO: 239515 - DNA, 27 bp, Artificial sequence
  SiRNA target sequence
ttttggatcagtttatggatttacaat

SEQ ID NO: 239516 - DNA, 27 bp, Artificial sequence
  SiRNA target sequence
tttggatcagtttatggatttacaatt

SEQ ID NO: 239517 - DNA, 27 bp, Artificial sequence
  SiRNA target sequence
ttggatcagtttatggatttacaatta

SEQ ID NO: 239518 - DNA, 27 bp, Artificial sequence
  SiRNA target sequence
tggatcagtttatggatttacaattac

SEQ ID NO: 239519 - DNA, 27 bp, Artificial sequence
  SiRNA target sequence
ggatcagtttatggatttacaattact

SEQ ID NO: 239520 - DNA, 27 bp, Artificial sequence
  SiRNA target sequence
gatcagtttatggatttacaattacta

SEQ ID NO: 239521 - DNA, 27 bp, Artificial sequence
  SiRNA target sequence
atcagtttatggatttacaattactac

SEQ ID NO: 239522 - DNA, 27 bp, Artificial sequence
  SiRNA target sequence
tcagtttatggatttacaattactaca

SEQ ID NO: 239523 - DNA, 27 bp, Artificial sequence
  SiRNA target sequence
cagtttatggatttacaattactacat

SEQ ID NO: 239524 - DNA, 27 bp, Artificial sequence
  SiRNA target sequence
agtttatggatttacaattactacatt

SEQ ID NO: 239525 - DNA, 27 bp, Artificial sequence
  SiRNA target sequence
gtttatggatttacaattactacatta

SEQ ID NO: 239526 - DNA, 27 bp, Artificial sequence
  SiRNA target sequence
tttatggatttacaattactacattat

SEQ ID NO: 239527 - DNA, 27 bp, Artificial sequence
  SiRNA target sequence
ttatggatttacaattactacattatt

SEQ ID NO: 239528 - DNA, 27 bp, Artificial sequence
  SiRNA target sequence
tatggatttacaattactacattatta

SEQ ID NO: 239529 - DNA, 27 bp, Artificial sequence
  SiRNA target sequence
atggatttacaattactacattattag

SEQ ID NO: 239530 - DNA, 27 bp, Artificial sequence
  SiRNA target sequence
tggatttacaattactacattattagg

SEQ ID NO: 239531 - DNA, 27 bp, Artificial sequence
  SiRNA target sequence
ggatttacaattactacattattagga

SEQ ID NO: 239532 - DNA, 27 bp, Artificial sequence
  SiRNA target sequence
gatttacaattactacattattaggaa

SEQ ID NO: 239533 - DNA, 27 bp, Artificial sequence
  SiRNA target sequence
atttacaattactacattattaggaac

SEQ ID NO: 239534 - DNA, 27 bp, Artificial sequence
  SiRNA target sequence
tttacaattactacattattaggaaca

SEQ ID NO: 239535 - DNA, 27 bp, Artificial sequence
  SiRNA target sequence
ttacaattactacattattaggaacaa

SEQ ID NO: 239536 - DNA, 27 bp, Artificial sequence
  SiRNA target sequence
tacaattactacattattaggaacaag

SEQ ID NO: 239537 - DNA, 27 bp, Artificial sequence
  SiRNA target sequence
acaattactacattattaggaacaaga

SEQ ID NO: 239538 - DNA, 27 bp, Artificial sequence
  SiRNA target sequence
caattactacattattaggaacaagag

SEQ ID NO: 239539 - DNA, 27 bp, Artificial sequence
  SiRNA target sequence
aattactacattattaggaacaagaga

SEQ ID NO: 239540 - DNA, 27 bp, Artificial sequence
  SiRNA target sequence
attactacattattaggaacaagagat

SEQ ID NO: 239541 - DNA, 27 bp, Artificial sequence
  SiRNA target sequence
ttactacattattaggaacaagagatg

SEQ ID NO: 239542 - DNA, 27 bp, Artificial sequence
  SiRNA target sequence
tactacattattaggaacaagagatgt

SEQ ID NO: 239543 - DNA, 27 bp, Artificial sequence
  SiRNA target sequence
actacattattaggaacaagagatgtt

SEQ ID NO: 239544 - DNA, 27 bp, Artificial sequence
  SiRNA target sequence
ctacattattaggaacaagagatgttc

SEQ ID NO: 239545 - DNA, 27 bp, Artificial sequence
  SiRNA target sequence
tacattattaggaacaagagatgttcg

SEQ ID NO: 239546 - DNA, 27 bp, Artificial sequence
  SiRNA target sequence
acattattaggaacaagagatgttcgt

SEQ ID NO: 239547 - DNA, 27 bp, Artificial sequence
  SiRNA target sequence
cattattaggaacaagagatgttcgta

SEQ ID NO: 239548 - DNA, 27 bp, Artificial sequence
  SiRNA target sequence
attattaggaacaagagatgttcgtag

SEQ ID NO: 239549 - DNA, 27 bp, Artificial sequence
  SiRNA target sequence
ttattaggaacaagagatgttcgtaga

SEQ ID NO: 239550 - DNA, 27 bp, Artificial sequence
  SiRNA target sequence
tattaggaacaagagatgttcgtagag

SEQ ID NO: 239551 - DNA, 27 bp, Artificial sequence
  SiRNA target sequence
attaggaacaagagatgttcgtagagg

SEQ ID NO: 239552 - DNA, 27 bp, Artificial sequence
  SiRNA target sequence
ttaggaacaagagatgttcgtagaggt

SEQ ID NO: 239553 - DNA, 27 bp, Artificial sequence
  SiRNA target sequence
taggaacaagagatgttcgtagaggtg

SEQ ID NO: 239554 - DNA, 27 bp, Artificial sequence
  SiRNA target sequence
aggaacaagagatgttcgtagaggtgc

SEQ ID NO: 239555 - DNA, 27 bp, Artificial sequence
  SiRNA target sequence
ggaacaagagatgttcgtagaggtgct

SEQ ID NO: 239556 - DNA, 27 bp, Artificial sequence
  SiRNA target sequence
gaacaagagatgttcgtagaggtgctc

SEQ ID NO: 239557 - DNA, 27 bp, Artificial sequence
  SiRNA target sequence
aacaagagatgttcgtagaggtgctcc

SEQ ID NO: 239558 - DNA, 27 bp, Artificial sequence
  SiRNA target sequence
acaagagatgttcgtagaggtgctcct

SEQ ID NO: 239559 - DNA, 27 bp, Artificial sequence
  SiRNA target sequence
caagagatgttcgtagaggtgctccta

SEQ ID NO: 239560 - DNA, 27 bp, Artificial sequence
  SiRNA target sequence
aagagatgttcgtagaggtgctcctat

SEQ ID NO: 239561 - DNA, 27 bp, Artificial sequence
  SiRNA target sequence
agagatgttcgtagaggtgctcctata

SEQ ID NO: 239562 - DNA, 27 bp, Artificial sequence
  SiRNA target sequence
gagatgttcgtagaggtgctcctatat

SEQ ID NO: 239563 - DNA, 27 bp, Artificial sequence
  SiRNA target sequence
agatgttcgtagaggtgctcctatatc

SEQ ID NO: 239564 - DNA, 27 bp, Artificial sequence
  SiRNA target sequence
gatgttcgtagaggtgctcctatatcg

SEQ ID NO: 239565 - DNA, 27 bp, Artificial sequence
  SiRNA target sequence
atgttcgtagaggtgctcctatatcgc

SEQ ID NO: 239566 - DNA, 27 bp, Artificial sequence
  SiRNA target sequence
tgttcgtagaggtgctcctatatcgct

SEQ ID NO: 239567 - DNA, 27 bp, Artificial sequence
  SiRNA target sequence
gttcgtagaggtgctcctatatcgctt

SEQ ID NO: 239568 - DNA, 27 bp, Artificial sequence
  SiRNA target sequence
ttcgtagaggtgctcctatatcgcttt

SEQ ID NO: 239569 - DNA, 27 bp, Artificial sequence
  SiRNA target sequence
tcgtagaggtgctcctatatcgctttg

SEQ ID NO: 239570 - DNA, 27 bp, Artificial sequence
  SiRNA target sequence
cgtagaggtgctcctatatcgctttgt

SEQ ID NO: 239571 - DNA, 27 bp, Artificial sequence
  SiRNA target sequence
gtagaggtgctcctatatcgctttgtg

SEQ ID NO: 239572 - DNA, 27 bp, Artificial sequence
  SiRNA target sequence
tagaggtgctcctatatcgctttgtgt

SEQ ID NO: 239573 - DNA, 27 bp, Artificial sequence
  SiRNA target sequence
agaggtgctcctatatcgctttgtgtt

SEQ ID NO: 239574 - DNA, 27 bp, Artificial sequence
  SiRNA target sequence
gaggtgctcctatatcgctttgtgttc

SEQ ID NO: 239575 - DNA, 27 bp, Artificial sequence
  SiRNA target sequence
aggtgctcctatatcgctttgtgttct

SEQ ID NO: 239576 - DNA, 27 bp, Artificial sequence
  SiRNA target sequence
ggtgctcctatatcgctttgtgttcta

SEQ ID NO: 239577 - DNA, 27 bp, Artificial sequence
  SiRNA target sequence
gtgctcctatatcgctttgtgttctaa

SEQ ID NO: 239578 - DNA, 27 bp, Artificial sequence
  SiRNA target sequence
tgctcctatatcgctttgtgttctaat

SEQ ID NO: 239579 - DNA, 27 bp, Artificial sequence
  SiRNA target sequence
gctcctatatcgctttgtgttctaata

SEQ ID NO: 239580 - DNA, 27 bp, Artificial sequence
  SiRNA target sequence
ctcctatatcgctttgtgttctaatat

SEQ ID NO: 239581 - DNA, 27 bp, Artificial sequence
  SiRNA target sequence
tcctatatcgctttgtgttctaatatt

SEQ ID NO: 239582 - DNA, 27 bp, Artificial sequence
  SiRNA target sequence
cctatatcgctttgtgttctaatattg

SEQ ID NO: 239583 - DNA, 27 bp, Artificial sequence
  SiRNA target sequence
ctatatcgctttgtgttctaatattgt

SEQ ID NO: 239584 - DNA, 27 bp, Artificial sequence
  SiRNA target sequence
tatatcgctttgtgttctaatattgtt

SEQ ID NO: 239585 - DNA, 27 bp, Artificial sequence
  SiRNA target sequence
atatcgctttgtgttctaatattgttc

SEQ ID NO: 239586 - DNA, 27 bp, Artificial sequence
  SiRNA target sequence
tatcgctttgtgttctaatattgttct

SEQ ID NO: 239587 - DNA, 27 bp, Artificial sequence
  SiRNA target sequence
atcgctttgtgttctaatattgttctg

SEQ ID NO: 239588 - DNA, 27 bp, Artificial sequence
  SiRNA target sequence
tcgctttgtgttctaatattgttctgc

SEQ ID NO: 239589 - DNA, 27 bp, Artificial sequence
  SiRNA target sequence
cgctttgtgttctaatattgttctgcc

SEQ ID NO: 239590 - DNA, 27 bp, Artificial sequence
  SiRNA target sequence
gctttgtgttctaatattgttctgcct

SEQ ID NO: 239591 - DNA, 27 bp, Artificial sequence
  SiRNA target sequence
ctttgtgttctaatattgttctgcctt

SEQ ID NO: 239592 - DNA, 27 bp, Artificial sequence
  SiRNA target sequence
tttgtgttctaatattgttctgcctta

SEQ ID NO: 239593 - DNA, 27 bp, Artificial sequence
  SiRNA target sequence
ttgtgttctaatattgttctgccttat

SEQ ID NO: 239594 - DNA, 27 bp, Artificial sequence
  SiRNA target sequence
tgtgttctaatattgttctgccttata

SEQ ID NO: 239595 - DNA, 27 bp, Artificial sequence
  SiRNA target sequence
gtgttctaatattgttctgccttatat

SEQ ID NO: 239596 - DNA, 27 bp, Artificial sequence
  SiRNA target sequence
tgttctaatattgttctgccttatatg

SEQ ID NO: 239597 - DNA, 27 bp, Artificial sequence
  SiRNA target sequence
gttctaatattgttctgccttatatgg

SEQ ID NO: 239598 - DNA, 27 bp, Artificial sequence
  SiRNA target sequence
ttctaatattgttctgccttatatggt

SEQ ID NO: 239599 - DNA, 27 bp, Artificial sequence
  SiRNA target sequence
tctaatattgttctgccttatatggtt

SEQ ID NO: 239600 - DNA, 27 bp, Artificial sequence
  SiRNA target sequence
ctaatattgttctgccttatatggttt

SEQ ID NO: 239601 - DNA, 27 bp, Artificial sequence
  SiRNA target sequence
taatattgttctgccttatatggtttt

SEQ ID NO: 239602 - DNA, 27 bp, Artificial sequence
  SiRNA target sequence
aatattgttctgccttatatggtttta

SEQ ID NO: 239603 - DNA, 27 bp, Artificial sequence
  SiRNA target sequence
atattgttctgccttatatggttttat

SEQ ID NO: 239604 - DNA, 27 bp, Artificial sequence
  SiRNA target sequence
tattgttctgccttatatggttttatt

SEQ ID NO: 239605 - DNA, 27 bp, Artificial sequence
  SiRNA target sequence
attgttctgccttatatggttttattc

SEQ ID NO: 239606 - DNA, 27 bp, Artificial sequence
  SiRNA target sequence
ttgttctgccttatatggttttattct

SEQ ID NO: 239607 - DNA, 27 bp, Artificial sequence
  SiRNA target sequence
tgttctgccttatatggttttattctg

SEQ ID NO: 239608 - DNA, 27 bp, Artificial sequence
  SiRNA target sequence
gttctgccttatatggttttattctgt

SEQ ID NO: 239609 - DNA, 27 bp, Artificial sequence
  SiRNA target sequence
ttctgccttatatggttttattctgtt

SEQ ID NO: 239610 - DNA, 27 bp, Artificial sequence
  SiRNA target sequence
tctgccttatatggttttattctgttt

SEQ ID NO: 239611 - DNA, 27 bp, Artificial sequence
  SiRNA target sequence
ctgccttatatggttttattctgtttt

SEQ ID NO: 239612 - DNA, 27 bp, Artificial sequence
  SiRNA target sequence
tgccttatatggttttattctgttttc

SEQ ID NO: 239613 - DNA, 27 bp, Artificial sequence
  SiRNA target sequence
gccttatatggttttattctgttttct

SEQ ID NO: 239614 - DNA, 27 bp, Artificial sequence
  SiRNA target sequence
ccttatatggttttattctgttttcta

SEQ ID NO: 239615 - DNA, 27 bp, Artificial sequence
  SiRNA target sequence
cttatatggttttattctgttttctat

SEQ ID NO: 239616 - DNA, 27 bp, Artificial sequence
  SiRNA target sequence
ttatatggttttattctgttttctatc

SEQ ID NO: 239617 - DNA, 27 bp, Artificial sequence
  SiRNA target sequence
tatatggttttattctgttttctatct

SEQ ID NO: 239618 - DNA, 27 bp, Artificial sequence
  SiRNA target sequence
atatggttttattctgttttctatctc

SEQ ID NO: 239619 - DNA, 27 bp, Artificial sequence
  SiRNA target sequence
tatggttttattctgttttctatctca

SEQ ID NO: 239620 - DNA, 27 bp, Artificial sequence
  SiRNA target sequence
atggttttattctgttttctatctcaa

SEQ ID NO: 239621 - DNA, 27 bp, Artificial sequence
  SiRNA target sequence
tggttttattctgttttctatctcaat

SEQ ID NO: 239622 - DNA, 27 bp, Artificial sequence
  SiRNA target sequence
ggttttattctgttttctatctcaata

SEQ ID NO: 239623 - DNA, 27 bp, Artificial sequence
  SiRNA target sequence
gttttattctgttttctatctcaatag

SEQ ID NO: 239624 - DNA, 27 bp, Artificial sequence
  SiRNA target sequence
ttttattctgttttctatctcaataga

SEQ ID NO: 239625 - DNA, 27 bp, Artificial sequence
  SiRNA target sequence
tttattctgttttctatctcaatagaa

SEQ ID NO: 239626 - DNA, 27 bp, Artificial sequence
  SiRNA target sequence
ttattctgttttctatctcaatagaaa

SEQ ID NO: 239627 - DNA, 27 bp, Artificial sequence
  SiRNA target sequence
tattctgttttctatctcaatagaaaa

SEQ ID NO: 239628 - DNA, 27 bp, Artificial sequence
  SiRNA target sequence
attctgttttctatctcaatagaaaat

SEQ ID NO: 239629 - DNA, 27 bp, Artificial sequence
  SiRNA target sequence
ttctgttttctatctcaatagaaaata

SEQ ID NO: 239630 - DNA, 27 bp, Artificial sequence
  SiRNA target sequence
tctgttttctatctcaatagaaaatat

SEQ ID NO: 239631 - DNA, 27 bp, Artificial sequence
  SiRNA target sequence
ctgttttctatctcaatagaaaatata

SEQ ID NO: 239632 - DNA, 27 bp, Artificial sequence
  SiRNA target sequence
tgttttctatctcaatagaaaatataa

SEQ ID NO: 239633 - DNA, 27 bp, Artificial sequence
  SiRNA target sequence
gttttctatctcaatagaaaatataaa

SEQ ID NO: 239634 - DNA, 27 bp, Artificial sequence
  SiRNA target sequence
ttttctatctcaatagaaaatataaag

SEQ ID NO: 239635 - DNA, 27 bp, Artificial sequence
  SiRNA target sequence
tttctatctcaatagaaaatataaaga

SEQ ID NO: 239636 - DNA, 27 bp, Artificial sequence
  SiRNA target sequence
ttctatctcaatagaaaatataaagaa

SEQ ID NO: 239637 - DNA, 27 bp, Artificial sequence
  SiRNA target sequence
tctatctcaatagaaaatataaagaat

SEQ ID NO: 239638 - DNA, 27 bp, Artificial sequence
  SiRNA target sequence
ctatctcaatagaaaatataaagaatc

SEQ ID NO: 239639 - DNA, 27 bp, Artificial sequence
  SiRNA target sequence
tatctcaatagaaaatataaagaatct

SEQ ID NO: 239640 - DNA, 27 bp, Artificial sequence
  SiRNA target sequence
atctcaatagaaaatataaagaatctg

SEQ ID NO: 239641 - DNA, 27 bp, Artificial sequence
  SiRNA target sequence
tctcaatagaaaatataaagaatctgt

SEQ ID NO: 239642 - DNA, 27 bp, Artificial sequence
  SiRNA target sequence
ctcaatagaaaatataaagaatctgtc

SEQ ID NO: 239643 - DNA, 27 bp, Artificial sequence
  SiRNA target sequence
tcaatagaaaatataaagaatctgtcg

SEQ ID NO: 239644 - DNA, 27 bp, Artificial sequence
  SiRNA target sequence
caatagaaaatataaagaatctgtcga

SEQ ID NO: 239645 - DNA, 27 bp, Artificial sequence
  SiRNA target sequence
aatagaaaatataaagaatctgtcgag

SEQ ID NO: 239646 - DNA, 27 bp, Artificial sequence
  SiRNA target sequence
atagaaaatataaagaatctgtcgaga

SEQ ID NO: 239647 - DNA, 27 bp, Artificial sequence
  SiRNA target sequence
tagaaaatataaagaatctgtcgagaa

SEQ ID NO: 239648 - DNA, 27 bp, Artificial sequence
  SiRNA target sequence
agaaaatataaagaatctgtcgagaat

SEQ ID NO: 239649 - DNA, 27 bp, Artificial sequence
  SiRNA target sequence
gaaaatataaagaatctgtcgagaata

SEQ ID NO: 239650 - DNA, 27 bp, Artificial sequence
  SiRNA target sequence
aaaatataaagaatctgtcgagaataa

SEQ ID NO: 239651 - DNA, 27 bp, Artificial sequence
  SiRNA target sequence
aaatataaagaatctgtcgagaataat

SEQ ID NO: 239652 - DNA, 27 bp, Artificial sequence
  SiRNA target sequence
aatataaagaatctgtcgagaataatg

SEQ ID NO: 239653 - DNA, 27 bp, Artificial sequence
  SiRNA target sequence
atataaagaatctgtcgagaataatgc

SEQ ID NO: 239654 - DNA, 27 bp, Artificial sequence
  SiRNA target sequence
tataaagaatctgtcgagaataatgca

SEQ ID NO: 239655 - DNA, 27 bp, Artificial sequence
  SiRNA target sequence
ataaagaatctgtcgagaataatgcac

SEQ ID NO: 239656 - DNA, 27 bp, Artificial sequence
  SiRNA target sequence
taaagaatctgtcgagaataatgcacc

SEQ ID NO: 239657 - DNA, 27 bp, Artificial sequence
  SiRNA target sequence
aaagaatctgtcgagaataatgcacca

SEQ ID NO: 239658 - DNA, 27 bp, Artificial sequence
  SiRNA target sequence
aagaatctgtcgagaataatgcaccaa

SEQ ID NO: 239659 - DNA, 27 bp, Artificial sequence
  SiRNA target sequence
agaatctgtcgagaataatgcaccaat

SEQ ID NO: 239660 - DNA, 27 bp, Artificial sequence
  SiRNA target sequence
gaatctgtcgagaataatgcaccaatt

SEQ ID NO: 239661 - DNA, 27 bp, Artificial sequence
  SiRNA target sequence
aatctgtcgagaataatgcaccaattg

SEQ ID NO: 239662 - DNA, 27 bp, Artificial sequence
  SiRNA target sequence
atctgtcgagaataatgcaccaattga

SEQ ID NO: 239663 - DNA, 27 bp, Artificial sequence
  SiRNA target sequence
tctgtcgagaataatgcaccaattgat

SEQ ID NO: 239664 - DNA, 27 bp, Artificial sequence
  SiRNA target sequence
ctgtcgagaataatgcaccaattgata

SEQ ID NO: 239665 - DNA, 27 bp, Artificial sequence
  SiRNA target sequence
tgtcgagaataatgcaccaattgatat

SEQ ID NO: 239666 - DNA, 27 bp, Artificial sequence
  SiRNA target sequence
gtcgagaataatgcaccaattgatatt

SEQ ID NO: 239667 - DNA, 27 bp, Artificial sequence
  SiRNA target sequence
tcgagaataatgcaccaattgatattg

SEQ ID NO: 239668 - DNA, 27 bp, Artificial sequence
  SiRNA target sequence
cgagaataatgcaccaattgatattga

SEQ ID NO: 239669 - DNA, 27 bp, Artificial sequence
  SiRNA target sequence
gagaataatgcaccaattgatattgat

SEQ ID NO: 239670 - DNA, 27 bp, Artificial sequence
  SiRNA target sequence
agaataatgcaccaattgatattgatt

SEQ ID NO: 239671 - DNA, 27 bp, Artificial sequence
  SiRNA target sequence
gaataatgcaccaattgatattgattt

SEQ ID NO: 239672 - DNA, 27 bp, Artificial sequence
  SiRNA target sequence
aataatgcaccaattgatattgattta

SEQ ID NO: 239673 - DNA, 27 bp, Artificial sequence
  SiRNA target sequence
ataatgcaccaattgatattgatttat

SEQ ID NO: 239674 - DNA, 27 bp, Artificial sequence
  SiRNA target sequence
taatgcaccaattgatattgatttatt

SEQ ID NO: 239675 - DNA, 27 bp, Artificial sequence
  SiRNA target sequence
aatgcaccaattgatattgatttattc

SEQ ID NO: 239676 - DNA, 27 bp, Artificial sequence
  SiRNA target sequence
atgcaccaattgatattgatttattca

SEQ ID NO: 239677 - DNA, 27 bp, Artificial sequence
  SiRNA target sequence
tgcaccaattgatattgatttattcac

SEQ ID NO: 239678 - DNA, 27 bp, Artificial sequence
  SiRNA target sequence
gcaccaattgatattgatttattcact

SEQ ID NO: 239679 - DNA, 27 bp, Artificial sequence
  SiRNA target sequence
caccaattgatattgatttattcacta

SEQ ID NO: 239680 - DNA, 27 bp, Artificial sequence
  SiRNA target sequence
accaattgatattgatttattcactag

SEQ ID NO: 239681 - DNA, 27 bp, Artificial sequence
  SiRNA target sequence
ccaattgatattgatttattcactagt

SEQ ID NO: 239682 - DNA, 27 bp, Artificial sequence
  SiRNA target sequence
caattgatattgatttattcactagtt

SEQ ID NO: 239683 - DNA, 27 bp, Artificial sequence
  SiRNA target sequence
aattgatattgatttattcactagttc

SEQ ID NO: 239684 - DNA, 27 bp, Artificial sequence
  SiRNA target sequence
attgatattgatttattcactagttca

SEQ ID NO: 239685 - DNA, 27 bp, Artificial sequence
  SiRNA target sequence
ttgatattgatttattcactagttcaa

SEQ ID NO: 239686 - DNA, 27 bp, Artificial sequence
  SiRNA target sequence
tgatattgatttattcactagttcaaa

SEQ ID NO: 239687 - DNA, 27 bp, Artificial sequence
  SiRNA target sequence
gatattgatttattcactagttcaaaa

SEQ ID NO: 239688 - DNA, 27 bp, Artificial sequence
  SiRNA target sequence
atattgatttattcactagttcaaaag

SEQ ID NO: 239689 - DNA, 27 bp, Artificial sequence
  SiRNA target sequence
tattgatttattcactagttcaaaagt

SEQ ID NO: 239690 - DNA, 27 bp, Artificial sequence
  SiRNA target sequence
attgatttattcactagttcaaaagtc

SEQ ID NO: 239691 - DNA, 27 bp, Artificial sequence
  SiRNA target sequence
ttgatttattcactagttcaaaagtca

SEQ ID NO: 239692 - DNA, 27 bp, Artificial sequence
  SiRNA target sequence
tgatttattcactagttcaaaagtcaa

SEQ ID NO: 239693 - DNA, 27 bp, Artificial sequence
  SiRNA target sequence
gatttattcactagttcaaaagtcaag

SEQ ID NO: 239694 - DNA, 27 bp, Artificial sequence
  SiRNA target sequence
atttattcactagttcaaaagtcaagg

SEQ ID NO: 239695 - DNA, 27 bp, Artificial sequence
  SiRNA target sequence
tttattcactagttcaaaagtcaaggc

SEQ ID NO: 239696 - DNA, 27 bp, Artificial sequence
  SiRNA target sequence
ttattcactagttcaaaagtcaaggca

SEQ ID NO: 239697 - DNA, 27 bp, Artificial sequence
  SiRNA target sequence
tattcactagttcaaaagtcaaggcac

SEQ ID NO: 239698 - DNA, 27 bp, Artificial sequence
  SiRNA target sequence
attcactagttcaaaagtcaaggcacc

SEQ ID NO: 239699 - DNA, 27 bp, Artificial sequence
  SiRNA target sequence
ttcactagttcaaaagtcaaggcacct

SEQ ID NO: 239700 - DNA, 27 bp, Artificial sequence
  SiRNA target sequence
tcactagttcaaaagtcaaggcacctt

SEQ ID NO: 239701 - DNA, 27 bp, Artificial sequence
  SiRNA target sequence
cactagttcaaaagtcaaggcaccttc

SEQ ID NO: 239702 - DNA, 27 bp, Artificial sequence
  SiRNA target sequence
actagttcaaaagtcaaggcaccttct

SEQ ID NO: 239703 - DNA, 27 bp, Artificial sequence
  SiRNA target sequence
ctagttcaaaagtcaaggcaccttctt

SEQ ID NO: 239704 - DNA, 27 bp, Artificial sequence
  SiRNA target sequence
tagttcaaaagtcaaggcaccttcttc

SEQ ID NO: 239705 - DNA, 27 bp, Artificial sequence
  SiRNA target sequence
agttcaaaagtcaaggcaccttcttct

SEQ ID NO: 239706 - DNA, 27 bp, Artificial sequence
  SiRNA target sequence
gttcaaaagtcaaggcaccttcttctg

SEQ ID NO: 239707 - DNA, 27 bp, Artificial sequence
  SiRNA target sequence
ttcaaaagtcaaggcaccttcttctga

SEQ ID NO: 239708 - DNA, 27 bp, Artificial sequence
  SiRNA target sequence
tcaaaagtcaaggcaccttcttctgaa

SEQ ID NO: 239709 - DNA, 27 bp, Artificial sequence
  SiRNA target sequence
caaaagtcaaggcaccttcttctgaac

SEQ ID NO: 239710 - DNA, 27 bp, Artificial sequence
  SiRNA target sequence
aaaagtcaaggcaccttcttctgaacc

SEQ ID NO: 239711 - DNA, 27 bp, Artificial sequence
  SiRNA target sequence
aaagtcaaggcaccttcttctgaacct

SEQ ID NO: 239712 - DNA, 27 bp, Artificial sequence
  SiRNA target sequence
aagtcaaggcaccttcttctgaaccta

SEQ ID NO: 239713 - DNA, 27 bp, Artificial sequence
  SiRNA target sequence
agtcaaggcaccttcttctgaacctac

SEQ ID NO: 239714 - DNA, 27 bp, Artificial sequence
  SiRNA target sequence
gtcaaggcaccttcttctgaacctact

SEQ ID NO: 239715 - DNA, 27 bp, Artificial sequence
  SiRNA target sequence
tcaaggcaccttcttctgaacctactg

SEQ ID NO: 239716 - DNA, 27 bp, Artificial sequence
  SiRNA target sequence
caaggcaccttcttctgaacctactgt

SEQ ID NO: 239717 - DNA, 27 bp, Artificial sequence
  SiRNA target sequence
aaggcaccttcttctgaacctactgtt

SEQ ID NO: 239718 - DNA, 27 bp, Artificial sequence
  SiRNA target sequence
aggcaccttcttctgaacctactgttg

SEQ ID NO: 239719 - DNA, 27 bp, Artificial sequence
  SiRNA target sequence
ggcaccttcttctgaacctactgttgc

SEQ ID NO: 239720 - DNA, 27 bp, Artificial sequence
  SiRNA target sequence
gcaccttcttctgaacctactgttgct

SEQ ID NO: 239721 - DNA, 27 bp, Artificial sequence
  SiRNA target sequence
caccttcttctgaacctactgttgcta

SEQ ID NO: 239722 - DNA, 27 bp, Artificial sequence
  SiRNA target sequence
accttcttctgaacctactgttgctac

SEQ ID NO: 239723 - DNA, 27 bp, Artificial sequence
  SiRNA target sequence
ccttcttctgaacctactgttgctacc

SEQ ID NO: 239724 - DNA, 27 bp, Artificial sequence
  SiRNA target sequence
cttcttctgaacctactgttgctacca

SEQ ID NO: 239725 - DNA, 27 bp, Artificial sequence
  SiRNA target sequence
ttcttctgaacctactgttgctaccaa

SEQ ID NO: 239726 - DNA, 27 bp, Artificial sequence
  SiRNA target sequence
tcttctgaacctactgttgctaccaaa

SEQ ID NO: 239727 - DNA, 27 bp, Artificial sequence
  SiRNA target sequence
cttctgaacctactgttgctaccaaaa

SEQ ID NO: 239728 - DNA, 27 bp, Artificial sequence
  SiRNA target sequence
ttctgaacctactgttgctaccaaaag

SEQ ID NO: 239729 - DNA, 27 bp, Artificial sequence
  SiRNA target sequence
tctgaacctactgttgctaccaaaagt

SEQ ID NO: 239730 - DNA, 27 bp, Artificial sequence
  SiRNA target sequence
ctgaacctactgttgctaccaaaagtg

SEQ ID NO: 239731 - DNA, 27 bp, Artificial sequence
  SiRNA target sequence
tgaacctactgttgctaccaaaagtgt

SEQ ID NO: 239732 - DNA, 27 bp, Artificial sequence
  SiRNA target sequence
gaacctactgttgctaccaaaagtgtt

SEQ ID NO: 239733 - DNA, 27 bp, Artificial sequence
  SiRNA target sequence
aacctactgttgctaccaaaagtgtta

SEQ ID NO: 239734 - DNA, 27 bp, Artificial sequence
  SiRNA target sequence
acctactgttgctaccaaaagtgttac

SEQ ID NO: 239735 - DNA, 27 bp, Artificial sequence
  SiRNA target sequence
cctactgttgctaccaaaagtgttact

SEQ ID NO: 239736 - DNA, 27 bp, Artificial sequence
  SiRNA target sequence
ctactgttgctaccaaaagtgttacta

SEQ ID NO: 239737 - DNA, 27 bp, Artificial sequence
  SiRNA target sequence
tactgttgctaccaaaagtgttactac

SEQ ID NO: 239738 - DNA, 27 bp, Artificial sequence
  SiRNA target sequence
actgttgctaccaaaagtgttactaca

SEQ ID NO: 239739 - DNA, 27 bp, Artificial sequence
  SiRNA target sequence
ctgttgctaccaaaagtgttactacag

SEQ ID NO: 239740 - DNA, 27 bp, Artificial sequence
  SiRNA target sequence
tgttgctaccaaaagtgttactacaga

SEQ ID NO: 239741 - DNA, 27 bp, Artificial sequence
  SiRNA target sequence
gttgctaccaaaagtgttactacagaa

SEQ ID NO: 239742 - DNA, 27 bp, Artificial sequence
  SiRNA target sequence
ttgctaccaaaagtgttactacagaag

SEQ ID NO: 239743 - DNA, 27 bp, Artificial sequence
  SiRNA target sequence
tgctaccaaaagtgttactacagaaga

SEQ ID NO: 239744 - DNA, 27 bp, Artificial sequence
  SiRNA target sequence
gctaccaaaagtgttactacagaagaa

SEQ ID NO: 239745 - DNA, 27 bp, Artificial sequence
  SiRNA target sequence
ctaccaaaagtgttactacagaagaat

SEQ ID NO: 239746 - DNA, 27 bp, Artificial sequence
  SiRNA target sequence
taccaaaagtgttactacagaagaata

SEQ ID NO: 239747 - DNA, 27 bp, Artificial sequence
  SiRNA target sequence
accaaaagtgttactacagaagaataa

SEQ ID NO: 239748 - DNA, 19 bp, Artificial sequence
  SiRNA target sequence
ttaattaaaatcaacatct

SEQ ID NO: 239749 - DNA, 19 bp, Artificial sequence
  SiRNA target sequence
taattaaaatcaacatcta

SEQ ID NO: 239750 - DNA, 19 bp, Artificial sequence
  SiRNA target sequence
aattaaaatcaacatctat

SEQ ID NO: 239751 - DNA, 19 bp, Artificial sequence
  SiRNA target sequence
attaaaatcaacatctatc

SEQ ID NO: 239752 - DNA, 19 bp, Artificial sequence
  SiRNA target sequence
ttaaaatcaacatctatct

SEQ ID NO: 239753 - DNA, 19 bp, Artificial sequence
  SiRNA target sequence
taaaatcaacatctatctc

SEQ ID NO: 239754 - DNA, 19 bp, Artificial sequence
  SiRNA target sequence
aaaatcaacatctatctca

SEQ ID NO: 239755 - DNA, 19 bp, Artificial sequence
  SiRNA target sequence
aaatcaacatctatctcag

SEQ ID NO: 239756 - DNA, 19 bp, Artificial sequence
  SiRNA target sequence
aatcaacatctatctcaga

SEQ ID NO: 239757 - DNA, 19 bp, Artificial sequence
  SiRNA target sequence
atcaacatctatctcagaa

SEQ ID NO: 239758 - DNA, 19 bp, Artificial sequence
  SiRNA target sequence
tcaacatctatctcagaat

SEQ ID NO: 239759 - DNA, 19 bp, Artificial sequence
  SiRNA target sequence
caacatctatctcagaatt

SEQ ID NO: 239760 - DNA, 19 bp, Artificial sequence
  SiRNA target sequence
aacatctatctcagaattt

SEQ ID NO: 239761 - DNA, 19 bp, Artificial sequence
  SiRNA target sequence
acatctatctcagaatttt

SEQ ID NO: 239762 - DNA, 19 bp, Artificial sequence
  SiRNA target sequence
catctatctcagaattttg

SEQ ID NO: 239763 - DNA, 19 bp, Artificial sequence
  SiRNA target sequence
atctatctcagaattttgt

SEQ ID NO: 239764 - DNA, 19 bp, Artificial sequence
  SiRNA target sequence
tctatctcagaattttgtt

SEQ ID NO: 239765 - DNA, 19 bp, Artificial sequence
  SiRNA target sequence
ctatctcagaattttgttc

SEQ ID NO: 239766 - DNA, 19 bp, Artificial sequence
  SiRNA target sequence
tatctcagaattttgttca

SEQ ID NO: 239767 - DNA, 19 bp, Artificial sequence
  SiRNA target sequence
atctcagaattttgttcaa

SEQ ID NO: 239768 - DNA, 19 bp, Artificial sequence
  SiRNA target sequence
tctcagaattttgttcaat

SEQ ID NO: 239769 - DNA, 19 bp, Artificial sequence
  SiRNA target sequence
ctcagaattttgttcaatt

SEQ ID NO: 239770 - DNA, 19 bp, Artificial sequence
  SiRNA target sequence
tcagaattttgttcaattg

SEQ ID NO: 239771 - DNA, 19 bp, Artificial sequence
  SiRNA target sequence
cagaattttgttcaattga

SEQ ID NO: 239772 - DNA, 19 bp, Artificial sequence
  SiRNA target sequence
agaattttgttcaattgat

SEQ ID NO: 239773 - DNA, 19 bp, Artificial sequence
  SiRNA target sequence
gaattttgttcaattgatt

SEQ ID NO: 239774 - DNA, 19 bp, Artificial sequence
  SiRNA target sequence
aattttgttcaattgattc

SEQ ID NO: 239775 - DNA, 19 bp, Artificial sequence
  SiRNA target sequence
attttgttcaattgattca

SEQ ID NO: 239776 - DNA, 19 bp, Artificial sequence
  SiRNA target sequence
ttttgttcaattgattcat

SEQ ID NO: 239777 - DNA, 19 bp, Artificial sequence
  SiRNA target sequence
tttgttcaattgattcatt

SEQ ID NO: 239778 - DNA, 19 bp, Artificial sequence
  SiRNA target sequence
ttgttcaattgattcatta

SEQ ID NO: 239779 - DNA, 19 bp, Artificial sequence
  SiRNA target sequence
tgttcaattgattcattat

SEQ ID NO: 239780 - DNA, 19 bp, Artificial sequence
  SiRNA target sequence
gttcaattgattcattata

SEQ ID NO: 239781 - DNA, 19 bp, Artificial sequence
  SiRNA target sequence
ttcaattgattcattatat

SEQ ID NO: 239782 - DNA, 19 bp, Artificial sequence
  SiRNA target sequence
tcaattgattcattatatt

SEQ ID NO: 239783 - DNA, 19 bp, Artificial sequence
  SiRNA target sequence
caattgattcattatattt

SEQ ID NO: 239784 - DNA, 19 bp, Artificial sequence
  SiRNA target sequence
aattgattcattatatttt

SEQ ID NO: 239785 - DNA, 19 bp, Artificial sequence
  SiRNA target sequence
attgattcattatattttt

SEQ ID NO: 239786 - DNA, 19 bp, Artificial sequence
  SiRNA target sequence
ttgattcattatatttttt

SEQ ID NO: 239787 - DNA, 19 bp, Artificial sequence
  SiRNA target sequence
tgattcattatatttttta

SEQ ID NO: 239788 - DNA, 19 bp, Artificial sequence
  SiRNA target sequence
gattcattatattttttac

SEQ ID NO: 239789 - DNA, 19 bp, Artificial sequence
  SiRNA target sequence
attcattatattttttact

SEQ ID NO: 239790 - DNA, 19 bp, Artificial sequence
  SiRNA target sequence
ttcattatattttttactt

SEQ ID NO: 239791 - DNA, 19 bp, Artificial sequence
  SiRNA target sequence
tcattatattttttactta

SEQ ID NO: 239792 - DNA, 19 bp, Artificial sequence
  SiRNA target sequence
cattatattttttacttaa

SEQ ID NO: 239793 - DNA, 19 bp, Artificial sequence
  SiRNA target sequence
attatattttttacttaaa

SEQ ID NO: 239794 - DNA, 19 bp, Artificial sequence
  SiRNA target sequence
ttatattttttacttaaat

SEQ ID NO: 239795 - DNA, 19 bp, Artificial sequence
  SiRNA target sequence
tatattttttacttaaata

SEQ ID NO: 239796 - DNA, 19 bp, Artificial sequence
  SiRNA target sequence
atattttttacttaaataa

SEQ ID NO: 239797 - DNA, 19 bp, Artificial sequence
  SiRNA target sequence
tattttttacttaaataac

SEQ ID NO: 239798 - DNA, 19 bp, Artificial sequence
  SiRNA target sequence
attttttacttaaataaca

SEQ ID NO: 239799 - DNA, 19 bp, Artificial sequence
  SiRNA target sequence
ttttttacttaaataacag

SEQ ID NO: 239800 - DNA, 19 bp, Artificial sequence
  SiRNA target sequence
tttttacttaaataacaga

SEQ ID NO: 239801 - DNA, 19 bp, Artificial sequence
  SiRNA target sequence
ttttacttaaataacagac

SEQ ID NO: 239802 - DNA, 19 bp, Artificial sequence
  SiRNA target sequence
tttacttaaataacagaca

SEQ ID NO: 239803 - DNA, 19 bp, Artificial sequence
  SiRNA target sequence
ttacttaaataacagacac

SEQ ID NO: 239804 - DNA, 19 bp, Artificial sequence
  SiRNA target sequence
tacttaaataacagacact

SEQ ID NO: 239805 - DNA, 19 bp, Artificial sequence
  SiRNA target sequence
acttaaataacagacactc

SEQ ID NO: 239806 - DNA, 19 bp, Artificial sequence
  SiRNA target sequence
cttaaataacagacactcc

SEQ ID NO: 239807 - DNA, 19 bp, Artificial sequence
  SiRNA target sequence
ttaaataacagacactcct

SEQ ID NO: 239808 - DNA, 19 bp, Artificial sequence
  SiRNA target sequence
taaataacagacactcctg

SEQ ID NO: 239809 - DNA, 19 bp, Artificial sequence
  SiRNA target sequence
aaataacagacactcctga

SEQ ID NO: 239810 - DNA, 19 bp, Artificial sequence
  SiRNA target sequence
aataacagacactcctgat

SEQ ID NO: 239811 - DNA, 19 bp, Artificial sequence
  SiRNA target sequence
ataacagacactcctgatc

SEQ ID NO: 239812 - DNA, 19 bp, Artificial sequence
  SiRNA target sequence
taacagacactcctgatcc

SEQ ID NO: 239813 - DNA, 19 bp, Artificial sequence
  SiRNA target sequence
aacagacactcctgatcca

SEQ ID NO: 239814 - DNA, 19 bp, Artificial sequence
  SiRNA target sequence
acagacactcctgatccac

SEQ ID NO: 239815 - DNA, 19 bp, Artificial sequence
  SiRNA target sequence
cagacactcctgatccaca

SEQ ID NO: 239816 - DNA, 19 bp, Artificial sequence
  SiRNA target sequence
agacactcctgatccacaa

SEQ ID NO: 239817 - DNA, 19 bp, Artificial sequence
  SiRNA target sequence
gacactcctgatccacaaa

SEQ ID NO: 239818 - DNA, 19 bp, Artificial sequence
  SiRNA target sequence
acactcctgatccacaaaa

SEQ ID NO: 239819 - DNA, 19 bp, Artificial sequence
  SiRNA target sequence
cactcctgatccacaaaaa

SEQ ID NO: 239820 - DNA, 19 bp, Artificial sequence
  SiRNA target sequence
actcctgatccacaaaaaa

SEQ ID NO: 239821 - DNA, 19 bp, Artificial sequence
  SiRNA target sequence
ctcctgatccacaaaaaat

SEQ ID NO: 239822 - DNA, 19 bp, Artificial sequence
  SiRNA target sequence
tcctgatccacaaaaaatt

SEQ ID NO: 239823 - DNA, 19 bp, Artificial sequence
  SiRNA target sequence
cctgatccacaaaaaattt

SEQ ID NO: 239824 - DNA, 19 bp, Artificial sequence
  SiRNA target sequence
ctgatccacaaaaaatttg

SEQ ID NO: 239825 - DNA, 19 bp, Artificial sequence
  SiRNA target sequence
tgatccacaaaaaatttgc

SEQ ID NO: 239826 - DNA, 19 bp, Artificial sequence
  SiRNA target sequence
gatccacaaaaaatttgca

SEQ ID NO: 239827 - DNA, 19 bp, Artificial sequence
  SiRNA target sequence
atccacaaaaaatttgcaa

SEQ ID NO: 239828 - DNA, 19 bp, Artificial sequence
  SiRNA target sequence
tccacaaaaaatttgcaaa

SEQ ID NO: 239829 - DNA, 19 bp, Artificial sequence
  SiRNA target sequence
ccacaaaaaatttgcaaat

SEQ ID NO: 239830 - DNA, 19 bp, Artificial sequence
  SiRNA target sequence
cacaaaaaatttgcaaata

SEQ ID NO: 239831 - DNA, 19 bp, Artificial sequence
  SiRNA target sequence
acaaaaaatttgcaaatat

SEQ ID NO: 239832 - DNA, 19 bp, Artificial sequence
  SiRNA target sequence
caaaaaatttgcaaatatt

SEQ ID NO: 239833 - DNA, 19 bp, Artificial sequence
  SiRNA target sequence
aaaaaatttgcaaatatta

SEQ ID NO: 239834 - DNA, 19 bp, Artificial sequence
  SiRNA target sequence
aaaaatttgcaaatattaa

SEQ ID NO: 239835 - DNA, 19 bp, Artificial sequence
  SiRNA target sequence
aaaatttgcaaatattaaa

SEQ ID NO: 239836 - DNA, 19 bp, Artificial sequence
  SiRNA target sequence
aaatttgcaaatattaaaa

SEQ ID NO: 239837 - DNA, 19 bp, Artificial sequence
  SiRNA target sequence
aatttgcaaatattaaaaa

SEQ ID NO: 239838 - DNA, 19 bp, Artificial sequence
  SiRNA target sequence
atttgcaaatattaaaaat

SEQ ID NO: 239839 - DNA, 19 bp, Artificial sequence
  SiRNA target sequence
tttgcaaatattaaaaata

SEQ ID NO: 239840 - DNA, 19 bp, Artificial sequence
  SiRNA target sequence
ttgcaaatattaaaaatat

SEQ ID NO: 239841 - DNA, 19 bp, Artificial sequence
  SiRNA target sequence
tgcaaatattaaaaatata

SEQ ID NO: 239842 - DNA, 19 bp, Artificial sequence
  SiRNA target sequence
gcaaatattaaaaatataa

SEQ ID NO: 239843 - DNA, 19 bp, Artificial sequence
  SiRNA target sequence
caaatattaaaaatataaa

SEQ ID NO: 239844 - DNA, 19 bp, Artificial sequence
  SiRNA target sequence
aaatattaaaaatataaaa

SEQ ID NO: 239845 - DNA, 19 bp, Artificial sequence
  SiRNA target sequence
aatattaaaaatataaaag

SEQ ID NO: 239846 - DNA, 19 bp, Artificial sequence
  SiRNA target sequence
atattaaaaatataaaaga

SEQ ID NO: 239847 - DNA, 19 bp, Artificial sequence
  SiRNA target sequence
tattaaaaatataaaagac

SEQ ID NO: 239848 - DNA, 19 bp, Artificial sequence
  SiRNA target sequence
attaaaaatataaaagaca

SEQ ID NO: 239849 - DNA, 19 bp, Artificial sequence
  SiRNA target sequence
ttaaaaatataaaagacac

SEQ ID NO: 239850 - DNA, 19 bp, Artificial sequence
  SiRNA target sequence
taaaaatataaaagacacg

SEQ ID NO: 239851 - DNA, 19 bp, Artificial sequence
  SiRNA target sequence
aaaaatataaaagacacgt

SEQ ID NO: 239852 - DNA, 19 bp, Artificial sequence
  SiRNA target sequence
aaaatataaaagacacgta

SEQ ID NO: 239853 - DNA, 19 bp, Artificial sequence
  SiRNA target sequence
aaatataaaagacacgtat

SEQ ID NO: 239854 - DNA, 19 bp, Artificial sequence
  SiRNA target sequence
aatataaaagacacgtatg

SEQ ID NO: 239855 - DNA, 19 bp, Artificial sequence
  SiRNA target sequence
atataaaagacacgtatga

SEQ ID NO: 239856 - DNA, 19 bp, Artificial sequence
  SiRNA target sequence
tataaaagacacgtatgat

SEQ ID NO: 239857 - DNA, 19 bp, Artificial sequence
  SiRNA target sequence
ataaaagacacgtatgata

SEQ ID NO: 239858 - DNA, 19 bp, Artificial sequence
  SiRNA target sequence
taaaagacacgtatgatac

SEQ ID NO: 239859 - DNA, 19 bp, Artificial sequence
  SiRNA target sequence
aaaagacacgtatgatact

SEQ ID NO: 239860 - DNA, 19 bp, Artificial sequence
  SiRNA target sequence
aaagacacgtatgatactt

SEQ ID NO: 239861 - DNA, 19 bp, Artificial sequence
  SiRNA target sequence
aagacacgtatgatacttg

SEQ ID NO: 239862 - DNA, 19 bp, Artificial sequence
  SiRNA target sequence
agacacgtatgatacttgt

SEQ ID NO: 239863 - DNA, 19 bp, Artificial sequence
  SiRNA target sequence
gacacgtatgatacttgtc

SEQ ID NO: 239864 - DNA, 19 bp, Artificial sequence
  SiRNA target sequence
acacgtatgatacttgtct

SEQ ID NO: 239865 - DNA, 19 bp, Artificial sequence
  SiRNA target sequence
cacgtatgatacttgtcta

SEQ ID NO: 239866 - DNA, 19 bp, Artificial sequence
  SiRNA target sequence
acgtatgatacttgtctaa

SEQ ID NO: 239867 - DNA, 19 bp, Artificial sequence
  SiRNA target sequence
cgtatgatacttgtctaat

SEQ ID NO: 239868 - DNA, 19 bp, Artificial sequence
  SiRNA target sequence
gtatgatacttgtctaata

SEQ ID NO: 239869 - DNA, 19 bp, Artificial sequence
  SiRNA target sequence
tatgatacttgtctaatat

SEQ ID NO: 239870 - DNA, 19 bp, Artificial sequence
  SiRNA target sequence
atgatacttgtctaatatc

SEQ ID NO: 239871 - DNA, 19 bp, Artificial sequence
  SiRNA target sequence
tgatacttgtctaatatct

SEQ ID NO: 239872 - DNA, 19 bp, Artificial sequence
  SiRNA target sequence
gatacttgtctaatatctg

SEQ ID NO: 239873 - DNA, 19 bp, Artificial sequence
  SiRNA target sequence
atacttgtctaatatctgg

SEQ ID NO: 239874 - DNA, 19 bp, Artificial sequence
  SiRNA target sequence
tacttgtctaatatctgga

SEQ ID NO: 239875 - DNA, 19 bp, Artificial sequence
  SiRNA target sequence
acttgtctaatatctggaa

SEQ ID NO: 239876 - DNA, 19 bp, Artificial sequence
  SiRNA target sequence
cttgtctaatatctggaat

SEQ ID NO: 239877 - DNA, 19 bp, Artificial sequence
  SiRNA target sequence
ttgtctaatatctggaatt

SEQ ID NO: 239878 - DNA, 19 bp, Artificial sequence
  SiRNA target sequence
tgtctaatatctggaattt

SEQ ID NO: 239879 - DNA, 19 bp, Artificial sequence
  SiRNA target sequence
gtctaatatctggaatttc

SEQ ID NO: 239880 - DNA, 19 bp, Artificial sequence
  SiRNA target sequence
tctaatatctggaatttct

SEQ ID NO: 239881 - DNA, 19 bp, Artificial sequence
  SiRNA target sequence
ctaatatctggaatttcta

SEQ ID NO: 239882 - DNA, 19 bp, Artificial sequence
  SiRNA target sequence
taatatctggaatttctat

SEQ ID NO: 239883 - DNA, 19 bp, Artificial sequence
  SiRNA target sequence
aatatctggaatttctata

SEQ ID NO: 239884 - DNA, 19 bp, Artificial sequence
  SiRNA target sequence
atatctggaatttctataa

SEQ ID NO: 239885 - DNA, 19 bp, Artificial sequence
  SiRNA target sequence
tatctggaatttctataaa

SEQ ID NO: 239886 - DNA, 19 bp, Artificial sequence
  SiRNA target sequence
atctggaatttctataaac

SEQ ID NO: 239887 - DNA, 19 bp, Artificial sequence
  SiRNA target sequence
tctggaatttctataaacg

SEQ ID NO: 239888 - DNA, 19 bp, Artificial sequence
  SiRNA target sequence
ctggaatttctataaacgt

SEQ ID NO: 239889 - DNA, 19 bp, Artificial sequence
  SiRNA target sequence
tggaatttctataaacgtc

SEQ ID NO: 239890 - DNA, 19 bp, Artificial sequence
  SiRNA target sequence
ggaatttctataaacgtca

SEQ ID NO: 239891 - DNA, 19 bp, Artificial sequence
  SiRNA target sequence
gaatttctataaacgtcaa

SEQ ID NO: 239892 - DNA, 19 bp, Artificial sequence
  SiRNA target sequence
aatttctataaacgtcaaa

SEQ ID NO: 239893 - DNA, 19 bp, Artificial sequence
  SiRNA target sequence
atttctataaacgtcaaaa

SEQ ID NO: 239894 - DNA, 19 bp, Artificial sequence
  SiRNA target sequence
tttctataaacgtcaaaaa

SEQ ID NO: 239895 - DNA, 19 bp, Artificial sequence
  SiRNA target sequence
ttctataaacgtcaaaaaa

SEQ ID NO: 239896 - DNA, 19 bp, Artificial sequence
  SiRNA target sequence
tctataaacgtcaaaaaag

SEQ ID NO: 239897 - DNA, 19 bp, Artificial sequence
  SiRNA target sequence
ctataaacgtcaaaaaagt

SEQ ID NO: 239898 - DNA, 19 bp, Artificial sequence
  SiRNA target sequence
tataaacgtcaaaaaagtt

SEQ ID NO: 239899 - DNA, 19 bp, Artificial sequence
  SiRNA target sequence
ataaacgtcaaaaaagttc

SEQ ID NO: 239900 - DNA, 19 bp, Artificial sequence
  SiRNA target sequence
taaacgtcaaaaaagttcc

SEQ ID NO: 239901 - DNA, 19 bp, Artificial sequence
  SiRNA target sequence
aaacgtcaaaaaagttcca

SEQ ID NO: 239902 - DNA, 19 bp, Artificial sequence
  SiRNA target sequence
aacgtcaaaaaagttccat

SEQ ID NO: 239903 - DNA, 19 bp, Artificial sequence
  SiRNA target sequence
acgtcaaaaaagttccata

SEQ ID NO: 239904 - DNA, 19 bp, Artificial sequence
  SiRNA target sequence
cgtcaaaaaagttccatat

SEQ ID NO: 239905 - DNA, 19 bp, Artificial sequence
  SiRNA target sequence
gtcaaaaaagttccatata

SEQ ID NO: 239906 - DNA, 19 bp, Artificial sequence
  SiRNA target sequence
tcaaaaaagttccatataa

SEQ ID NO: 239907 - DNA, 19 bp, Artificial sequence
  SiRNA target sequence
caaaaaagttccatataaa

SEQ ID NO: 239908 - DNA, 19 bp, Artificial sequence
  SiRNA target sequence
aaaaaagttccatataaag

SEQ ID NO: 239909 - DNA, 19 bp, Artificial sequence
  SiRNA target sequence
aaaaagttccatataaaga

SEQ ID NO: 239910 - DNA, 19 bp, Artificial sequence
  SiRNA target sequence
aaaagttccatataaagag

SEQ ID NO: 239911 - DNA, 19 bp, Artificial sequence
  SiRNA target sequence
aaagttccatataaagaga

SEQ ID NO: 239912 - DNA, 19 bp, Artificial sequence
  SiRNA target sequence
aagttccatataaagagat

SEQ ID NO: 239913 - DNA, 19 bp, Artificial sequence
  SiRNA target sequence
agttccatataaagagata

SEQ ID NO: 239914 - DNA, 19 bp, Artificial sequence
  SiRNA target sequence
gttccatataaagagataa

SEQ ID NO: 239915 - DNA, 19 bp, Artificial sequence
  SiRNA target sequence
ttccatataaagagataat

SEQ ID NO: 239916 - DNA, 19 bp, Artificial sequence
  SiRNA target sequence
tccatataaagagataata

SEQ ID NO: 239917 - DNA, 19 bp, Artificial sequence
  SiRNA target sequence
ccatataaagagataatag

SEQ ID NO: 239918 - DNA, 19 bp, Artificial sequence
  SiRNA target sequence
catataaagagataataga

SEQ ID NO: 239919 - DNA, 19 bp, Artificial sequence
  SiRNA target sequence
atataaagagataatagat

SEQ ID NO: 239920 - DNA, 19 bp, Artificial sequence
  SiRNA target sequence
tataaagagataatagatt

SEQ ID NO: 239921 - DNA, 19 bp, Artificial sequence
  SiRNA target sequence
ataaagagataatagattt

SEQ ID NO: 239922 - DNA, 19 bp, Artificial sequence
  SiRNA target sequence
taaagagataatagattta

SEQ ID NO: 239923 - DNA, 19 bp, Artificial sequence
  SiRNA target sequence
aaagagataatagatttac

SEQ ID NO: 239924 - DNA, 19 bp, Artificial sequence
  SiRNA target sequence
aagagataatagatttacc

SEQ ID NO: 239925 - DNA, 19 bp, Artificial sequence
  SiRNA target sequence
agagataatagatttacca

SEQ ID NO: 239926 - DNA, 19 bp, Artificial sequence
  SiRNA target sequence
gagataatagatttaccaa

SEQ ID NO: 239927 - DNA, 19 bp, Artificial sequence
  SiRNA target sequence
agataatagatttaccaat

SEQ ID NO: 239928 - DNA, 19 bp, Artificial sequence
  SiRNA target sequence
gataatagatttaccaatt

SEQ ID NO: 239929 - DNA, 19 bp, Artificial sequence
  SiRNA target sequence
ataatagatttaccaattt

SEQ ID NO: 239930 - DNA, 19 bp, Artificial sequence
  SiRNA target sequence
taatagatttaccaatttt

SEQ ID NO: 239931 - DNA, 19 bp, Artificial sequence
  SiRNA target sequence
aatagatttaccaattttg

SEQ ID NO: 239932 - DNA, 19 bp, Artificial sequence
  SiRNA target sequence
atagatttaccaattttga

SEQ ID NO: 239933 - DNA, 19 bp, Artificial sequence
  SiRNA target sequence
tagatttaccaattttgat

SEQ ID NO: 239934 - DNA, 19 bp, Artificial sequence
  SiRNA target sequence
agatttaccaattttgata

SEQ ID NO: 239935 - DNA, 19 bp, Artificial sequence
  SiRNA target sequence
gatttaccaattttgatac

SEQ ID NO: 239936 - DNA, 19 bp, Artificial sequence
  SiRNA target sequence
atttaccaattttgataca

SEQ ID NO: 239937 - DNA, 19 bp, Artificial sequence
  SiRNA target sequence
tttaccaattttgatacat

SEQ ID NO: 239938 - DNA, 19 bp, Artificial sequence
  SiRNA target sequence
ttaccaattttgatacata

SEQ ID NO: 239939 - DNA, 19 bp, Artificial sequence
  SiRNA target sequence
taccaattttgatacatac

SEQ ID NO: 239940 - DNA, 19 bp, Artificial sequence
  SiRNA target sequence
accaattttgatacataca

SEQ ID NO: 239941 - DNA, 19 bp, Artificial sequence
  SiRNA target sequence
ccaattttgatacatacac

SEQ ID NO: 239942 - DNA, 19 bp, Artificial sequence
  SiRNA target sequence
caattttgatacatacacc

SEQ ID NO: 239943 - DNA, 19 bp, Artificial sequence
  SiRNA target sequence
aattttgatacatacacca

SEQ ID NO: 239944 - DNA, 19 bp, Artificial sequence
  SiRNA target sequence
attttgatacatacaccat

SEQ ID NO: 239945 - DNA, 19 bp, Artificial sequence
  SiRNA target sequence
ttttgatacatacaccatc

SEQ ID NO: 239946 - DNA, 19 bp, Artificial sequence
  SiRNA target sequence
tttgatacatacaccatca

SEQ ID NO: 239947 - DNA, 19 bp, Artificial sequence
  SiRNA target sequence
ttgatacatacaccatcat

SEQ ID NO: 239948 - DNA, 19 bp, Artificial sequence
  SiRNA target sequence
tgatacatacaccatcata

SEQ ID NO: 239949 - DNA, 19 bp, Artificial sequence
  SiRNA target sequence
gatacatacaccatcataa

SEQ ID NO: 239950 - DNA, 19 bp, Artificial sequence
  SiRNA target sequence
atacatacaccatcataaa

SEQ ID NO: 239951 - DNA, 19 bp, Artificial sequence
  SiRNA target sequence
tacatacaccatcataaaa

SEQ ID NO: 239952 - DNA, 19 bp, Artificial sequence
  SiRNA target sequence
acatacaccatcataaaaa

SEQ ID NO: 239953 - DNA, 19 bp, Artificial sequence
  SiRNA target sequence
catacaccatcataaaaac

SEQ ID NO: 239954 - DNA, 19 bp, Artificial sequence
  SiRNA target sequence
atacaccatcataaaaact

SEQ ID NO: 239955 - DNA, 19 bp, Artificial sequence
  SiRNA target sequence
tacaccatcataaaaactt

SEQ ID NO: 239956 - DNA, 19 bp, Artificial sequence
  SiRNA target sequence
acaccatcataaaaacttt

SEQ ID NO: 239957 - DNA, 19 bp, Artificial sequence
  SiRNA target sequence
caccatcataaaaactttt

SEQ ID NO: 239958 - DNA, 19 bp, Artificial sequence
  SiRNA target sequence
accatcataaaaactttta

SEQ ID NO: 239959 - DNA, 19 bp, Artificial sequence
  SiRNA target sequence
ccatcataaaaacttttaa

SEQ ID NO: 239960 - DNA, 19 bp, Artificial sequence
  SiRNA target sequence
catcataaaaacttttaaa

SEQ ID NO: 239961 - DNA, 19 bp, Artificial sequence
  SiRNA target sequence
atcataaaaacttttaaat

SEQ ID NO: 239962 - DNA, 19 bp, Artificial sequence
  SiRNA target sequence
tcataaaaacttttaaatt

SEQ ID NO: 239963 - DNA, 19 bp, Artificial sequence
  SiRNA target sequence
cataaaaacttttaaattt

SEQ ID NO: 239964 - DNA, 19 bp, Artificial sequence
  SiRNA target sequence
ataaaaacttttaaattta

SEQ ID NO: 239965 - DNA, 19 bp, Artificial sequence
  SiRNA target sequence
taaaaacttttaaatttat

SEQ ID NO: 239966 - DNA, 19 bp, Artificial sequence
  SiRNA target sequence
aaaaacttttaaatttata

SEQ ID NO: 239967 - DNA, 19 bp, Artificial sequence
  SiRNA target sequence
aaaacttttaaatttatac

SEQ ID NO: 239968 - DNA, 19 bp, Artificial sequence
  SiRNA target sequence
aaacttttaaatttatacc

SEQ ID NO: 239969 - DNA, 19 bp, Artificial sequence
  SiRNA target sequence
aacttttaaatttatacct

SEQ ID NO: 239970 - DNA, 19 bp, Artificial sequence
  SiRNA target sequence
acttttaaatttatacctg

SEQ ID NO: 239971 - DNA, 19 bp, Artificial sequence
  SiRNA target sequence
cttttaaatttatacctgt

SEQ ID NO: 239972 - DNA, 19 bp, Artificial sequence
  SiRNA target sequence
ttttaaatttatacctgta

SEQ ID NO: 239973 - DNA, 19 bp, Artificial sequence
  SiRNA target sequence
tttaaatttatacctgtat

SEQ ID NO: 239974 - DNA, 19 bp, Artificial sequence
  SiRNA target sequence
ttaaatttatacctgtatt

SEQ ID NO: 239975 - DNA, 19 bp, Artificial sequence
  SiRNA target sequence
taaatttatacctgtattt

SEQ ID NO: 239976 - DNA, 19 bp, Artificial sequence
  SiRNA target sequence
aaatttatacctgtattta

SEQ ID NO: 239977 - DNA, 19 bp, Artificial sequence
  SiRNA target sequence
aatttatacctgtatttaa

SEQ ID NO: 239978 - DNA, 19 bp, Artificial sequence
  SiRNA target sequence
atttatacctgtatttaac

SEQ ID NO: 239979 - DNA, 19 bp, Artificial sequence
  SiRNA target sequence
tttatacctgtatttaaca

SEQ ID NO: 239980 - DNA, 19 bp, Artificial sequence
  SiRNA target sequence
ttatacctgtatttaacag

SEQ ID NO: 239981 - DNA, 19 bp, Artificial sequence
  SiRNA target sequence
tatacctgtatttaacagg

SEQ ID NO: 239982 - DNA, 19 bp, Artificial sequence
  SiRNA target sequence
atacctgtatttaacaggc

SEQ ID NO: 239983 - DNA, 19 bp, Artificial sequence
  SiRNA target sequence
tacctgtatttaacaggca

SEQ ID NO: 239984 - DNA, 19 bp, Artificial sequence
  SiRNA target sequence
acctgtatttaacaggcac

SEQ ID NO: 239985 - DNA, 19 bp, Artificial sequence
  SiRNA target sequence
cctgtatttaacaggcacc

SEQ ID NO: 239986 - DNA, 19 bp, Artificial sequence
  SiRNA target sequence
ctgtatttaacaggcaccc

SEQ ID NO: 239987 - DNA, 19 bp, Artificial sequence
  SiRNA target sequence
tgtatttaacaggcaccct

SEQ ID NO: 239988 - DNA, 19 bp, Artificial sequence
  SiRNA target sequence
gtatttaacaggcaccctc

SEQ ID NO: 239989 - DNA, 19 bp, Artificial sequence
  SiRNA target sequence
tatttaacaggcaccctca

SEQ ID NO: 239990 - DNA, 19 bp, Artificial sequence
  SiRNA target sequence
atttaacaggcaccctcat

SEQ ID NO: 239991 - DNA, 19 bp, Artificial sequence
  SiRNA target sequence
tttaacaggcaccctcata

SEQ ID NO: 239992 - DNA, 19 bp, Artificial sequence
  SiRNA target sequence
ttaacaggcaccctcatag

SEQ ID NO: 239993 - DNA, 19 bp, Artificial sequence
  SiRNA target sequence
taacaggcaccctcataga

SEQ ID NO: 239994 - DNA, 19 bp, Artificial sequence
  SiRNA target sequence
aacaggcaccctcatagaa

SEQ ID NO: 239995 - DNA, 19 bp, Artificial sequence
  SiRNA target sequence
acaggcaccctcatagaaa

SEQ ID NO: 239996 - DNA, 19 bp, Artificial sequence
  SiRNA target sequence
caggcaccctcatagaaag

SEQ ID NO: 239997 - DNA, 19 bp, Artificial sequence
  SiRNA target sequence
aggcaccctcatagaaagc

SEQ ID NO: 239998 - DNA, 19 bp, Artificial sequence
  SiRNA target sequence
ggcaccctcatagaaagca

SEQ ID NO: 239999 - DNA, 19 bp, Artificial sequence
  SiRNA target sequence
gcaccctcatagaaagcat

SEQ ID NO: 240000 - DNA, 19 bp, Artificial sequence
  SiRNA target sequence
caccctcatagaaagcatt

SEQ ID NO: 240001 - DNA, 19 bp, Artificial sequence
  SiRNA target sequence
accctcatagaaagcattt

SEQ ID NO: 240002 - DNA, 19 bp, Artificial sequence
  SiRNA target sequence
ccctcatagaaagcatttc

SEQ ID NO: 240003 - DNA, 19 bp, Artificial sequence
  SiRNA target sequence
cctcatagaaagcatttct

SEQ ID NO: 240004 - DNA, 19 bp, Artificial sequence
  SiRNA target sequence
ctcatagaaagcatttctt

SEQ ID NO: 240005 - DNA, 19 bp, Artificial sequence
  SiRNA target sequence
tcatagaaagcatttcttt

SEQ ID NO: 240006 - DNA, 19 bp, Artificial sequence
  SiRNA target sequence
catagaaagcatttctttt

SEQ ID NO: 240007 - DNA, 19 bp, Artificial sequence
  SiRNA target sequence
atagaaagcatttcttttg

SEQ ID NO: 240008 - DNA, 19 bp, Artificial sequence
  SiRNA target sequence
tagaaagcatttcttttgc

SEQ ID NO: 240009 - DNA, 19 bp, Artificial sequence
  SiRNA target sequence
agaaagcatttcttttgct

SEQ ID NO: 240010 - DNA, 19 bp, Artificial sequence
  SiRNA target sequence
gaaagcatttcttttgcta

SEQ ID NO: 240011 - DNA, 19 bp, Artificial sequence
  SiRNA target sequence
aaagcatttcttttgctaa

SEQ ID NO: 240012 - DNA, 19 bp, Artificial sequence
  SiRNA target sequence
aagcatttcttttgctaaa

SEQ ID NO: 240013 - DNA, 19 bp, Artificial sequence
  SiRNA target sequence
agcatttcttttgctaaat

SEQ ID NO: 240014 - DNA, 19 bp, Artificial sequence
  SiRNA target sequence
gcatttcttttgctaaatc

SEQ ID NO: 240015 - DNA, 19 bp, Artificial sequence
  SiRNA target sequence
catttcttttgctaaatca

SEQ ID NO: 240016 - DNA, 19 bp, Artificial sequence
  SiRNA target sequence
atttcttttgctaaatcaa

SEQ ID NO: 240017 - DNA, 19 bp, Artificial sequence
  SiRNA target sequence
tttcttttgctaaatcaaa

SEQ ID NO: 240018 - DNA, 19 bp, Artificial sequence
  SiRNA target sequence
ttcttttgctaaatcaaat

SEQ ID NO: 240019 - DNA, 19 bp, Artificial sequence
  SiRNA target sequence
tcttttgctaaatcaaata

SEQ ID NO: 240020 - DNA, 19 bp, Artificial sequence
  SiRNA target sequence
cttttgctaaatcaaataa

SEQ ID NO: 240021 - DNA, 19 bp, Artificial sequence
  SiRNA target sequence
ttttgctaaatcaaataaa

SEQ ID NO: 240022 - DNA, 19 bp, Artificial sequence
  SiRNA target sequence
tttgctaaatcaaataaaa

SEQ ID NO: 240023 - DNA, 19 bp, Artificial sequence
  SiRNA target sequence
ttgctaaatcaaataaaac

SEQ ID NO: 240024 - DNA, 19 bp, Artificial sequence
  SiRNA target sequence
tgctaaatcaaataaaaca

SEQ ID NO: 240025 - DNA, 19 bp, Artificial sequence
  SiRNA target sequence
gctaaatcaaataaaacat

SEQ ID NO: 240026 - DNA, 19 bp, Artificial sequence
  SiRNA target sequence
ctaaatcaaataaaacata

SEQ ID NO: 240027 - DNA, 19 bp, Artificial sequence
  SiRNA target sequence
taaatcaaataaaacatat

SEQ ID NO: 240028 - DNA, 19 bp, Artificial sequence
  SiRNA target sequence
aaatcaaataaaacatatt

SEQ ID NO: 240029 - DNA, 19 bp, Artificial sequence
  SiRNA target sequence
aatcaaataaaacatattt

SEQ ID NO: 240030 - DNA, 19 bp, Artificial sequence
  SiRNA target sequence
atcaaataaaacatatttg

SEQ ID NO: 240031 - DNA, 19 bp, Artificial sequence
  SiRNA target sequence
tcaaataaaacatatttgg

SEQ ID NO: 240032 - DNA, 19 bp, Artificial sequence
  SiRNA target sequence
caaataaaacatatttggt

SEQ ID NO: 240033 - DNA, 19 bp, Artificial sequence
  SiRNA target sequence
aaataaaacatatttggta

SEQ ID NO: 240034 - DNA, 19 bp, Artificial sequence
  SiRNA target sequence
aataaaacatatttggtaa

SEQ ID NO: 240035 - DNA, 19 bp, Artificial sequence
  SiRNA target sequence
ataaaacatatttggtaat

SEQ ID NO: 240036 - DNA, 19 bp, Artificial sequence
  SiRNA target sequence
taaaacatatttggtaatt

SEQ ID NO: 240037 - DNA, 19 bp, Artificial sequence
  SiRNA target sequence
aaaacatatttggtaattt

SEQ ID NO: 240038 - DNA, 19 bp, Artificial sequence
  SiRNA target sequence
aaacatatttggtaatttt

SEQ ID NO: 240039 - DNA, 19 bp, Artificial sequence
  SiRNA target sequence
aacatatttggtaatttta

SEQ ID NO: 240040 - DNA, 19 bp, Artificial sequence
  SiRNA target sequence
acatatttggtaattttag

SEQ ID NO: 240041 - DNA, 19 bp, Artificial sequence
  SiRNA target sequence
catatttggtaattttaga

SEQ ID NO: 240042 - DNA, 19 bp, Artificial sequence
  SiRNA target sequence
atatttggtaattttagaa

SEQ ID NO: 240043 - DNA, 19 bp, Artificial sequence
  SiRNA target sequence
tatttggtaattttagaaa

SEQ ID NO: 240044 - DNA, 19 bp, Artificial sequence
  SiRNA target sequence
atttggtaattttagaaaa

SEQ ID NO: 240045 - DNA, 19 bp, Artificial sequence
  SiRNA target sequence
tttggtaattttagaaaat

SEQ ID NO: 240046 - DNA, 19 bp, Artificial sequence
  SiRNA target sequence
ttggtaattttagaaaatg

SEQ ID NO: 240047 - DNA, 19 bp, Artificial sequence
  SiRNA target sequence
tggtaattttagaaaatgc

SEQ ID NO: 240048 - DNA, 19 bp, Artificial sequence
  SiRNA target sequence
ggtaattttagaaaatgca

SEQ ID NO: 240049 - DNA, 19 bp, Artificial sequence
  SiRNA target sequence
gtaattttagaaaatgcaa

SEQ ID NO: 240050 - DNA, 19 bp, Artificial sequence
  SiRNA target sequence
taattttagaaaatgcaaa

SEQ ID NO: 240051 - DNA, 19 bp, Artificial sequence
  SiRNA target sequence
aattttagaaaatgcaaat

SEQ ID NO: 240052 - DNA, 19 bp, Artificial sequence
  SiRNA target sequence
attttagaaaatgcaaatc

SEQ ID NO: 240053 - DNA, 19 bp, Artificial sequence
  SiRNA target sequence
ttttagaaaatgcaaatcc

SEQ ID NO: 240054 - DNA, 19 bp, Artificial sequence
  SiRNA target sequence
tttagaaaatgcaaatcca

SEQ ID NO: 240055 - DNA, 19 bp, Artificial sequence
  SiRNA target sequence
ttagaaaatgcaaatccaa

SEQ ID NO: 240056 - DNA, 19 bp, Artificial sequence
  SiRNA target sequence
tagaaaatgcaaatccaat

SEQ ID NO: 240057 - DNA, 19 bp, Artificial sequence
  SiRNA target sequence
agaaaatgcaaatccaatg

SEQ ID NO: 240058 - DNA, 19 bp, Artificial sequence
  SiRNA target sequence
gaaaatgcaaatccaatgg

SEQ ID NO: 240059 - DNA, 19 bp, Artificial sequence
  SiRNA target sequence
aaaatgcaaatccaatggt

SEQ ID NO: 240060 - DNA, 19 bp, Artificial sequence
  SiRNA target sequence
aaatgcaaatccaatggtt

SEQ ID NO: 240061 - DNA, 19 bp, Artificial sequence
  SiRNA target sequence
aatgcaaatccaatggttg

SEQ ID NO: 240062 - DNA, 19 bp, Artificial sequence
  SiRNA target sequence
atgcaaatccaatggttgc

SEQ ID NO: 240063 - DNA, 19 bp, Artificial sequence
  SiRNA target sequence
tgcaaatccaatggttgca

SEQ ID NO: 240064 - DNA, 19 bp, Artificial sequence
  SiRNA target sequence
gcaaatccaatggttgcac

SEQ ID NO: 240065 - DNA, 19 bp, Artificial sequence
  SiRNA target sequence
caaatccaatggttgcaca

SEQ ID NO: 240066 - DNA, 19 bp, Artificial sequence
  SiRNA target sequence
aaatccaatggttgcacac

SEQ ID NO: 240067 - DNA, 19 bp, Artificial sequence
  SiRNA target sequence
aatccaatggttgcacacc

SEQ ID NO: 240068 - DNA, 19 bp, Artificial sequence
  SiRNA target sequence
atccaatggttgcacacca

SEQ ID NO: 240069 - DNA, 19 bp, Artificial sequence
  SiRNA target sequence
tccaatggttgcacaccaa

SEQ ID NO: 240070 - DNA, 19 bp, Artificial sequence
  SiRNA target sequence
ccaatggttgcacaccaat

SEQ ID NO: 240071 - DNA, 19 bp, Artificial sequence
  SiRNA target sequence
caatggttgcacaccaatt

SEQ ID NO: 240072 - DNA, 19 bp, Artificial sequence
  SiRNA target sequence
aatggttgcacaccaattt

SEQ ID NO: 240073 - DNA, 19 bp, Artificial sequence
  SiRNA target sequence
atggttgcacaccaatttt

SEQ ID NO: 240074 - DNA, 19 bp, Artificial sequence
  SiRNA target sequence
tggttgcacaccaattttc

SEQ ID NO: 240075 - DNA, 19 bp, Artificial sequence
  SiRNA target sequence
ggttgcacaccaattttca

SEQ ID NO: 240076 - DNA, 19 bp, Artificial sequence
  SiRNA target sequence
gttgcacaccaattttcaa

SEQ ID NO: 240077 - DNA, 19 bp, Artificial sequence
  SiRNA target sequence
ttgcacaccaattttcaag

SEQ ID NO: 240078 - DNA, 19 bp, Artificial sequence
  SiRNA target sequence
tgcacaccaattttcaaga

SEQ ID NO: 240079 - DNA, 19 bp, Artificial sequence
  SiRNA target sequence
gcacaccaattttcaagat

SEQ ID NO: 240080 - DNA, 19 bp, Artificial sequence
  SiRNA target sequence
cacaccaattttcaagatt

SEQ ID NO: 240081 - DNA, 19 bp, Artificial sequence
  SiRNA target sequence
acaccaattttcaagattt

SEQ ID NO: 240082 - DNA, 19 bp, Artificial sequence
  SiRNA target sequence
caccaattttcaagattta

SEQ ID NO: 240083 - DNA, 19 bp, Artificial sequence
  SiRNA target sequence
accaattttcaagatttat

SEQ ID NO: 240084 - DNA, 19 bp, Artificial sequence
  SiRNA target sequence
ccaattttcaagatttatt

SEQ ID NO: 240085 - DNA, 19 bp, Artificial sequence
  SiRNA target sequence
caattttcaagatttattc

SEQ ID NO: 240086 - DNA, 19 bp, Artificial sequence
  SiRNA target sequence
aattttcaagatttattct

SEQ ID NO: 240087 - DNA, 19 bp, Artificial sequence
  SiRNA target sequence
attttcaagatttattctt

SEQ ID NO: 240088 - DNA, 19 bp, Artificial sequence
  SiRNA target sequence
ttttcaagatttattctta

SEQ ID NO: 240089 - DNA, 19 bp, Artificial sequence
  SiRNA target sequence
tttcaagatttattcttaa

SEQ ID NO: 240090 - DNA, 19 bp, Artificial sequence
  SiRNA target sequence
ttcaagatttattcttaag

SEQ ID NO: 240091 - DNA, 19 bp, Artificial sequence
  SiRNA target sequence
tcaagatttattcttaaga

SEQ ID NO: 240092 - DNA, 19 bp, Artificial sequence
  SiRNA target sequence
caagatttattcttaagac

SEQ ID NO: 240093 - DNA, 19 bp, Artificial sequence
  SiRNA target sequence
aagatttattcttaagacc

SEQ ID NO: 240094 - DNA, 19 bp, Artificial sequence
  SiRNA target sequence
agatttattcttaagaccg

SEQ ID NO: 240095 - DNA, 19 bp, Artificial sequence
  SiRNA target sequence
gatttattcttaagaccga

SEQ ID NO: 240096 - DNA, 19 bp, Artificial sequence
  SiRNA target sequence
atttattcttaagaccgat

SEQ ID NO: 240097 - DNA, 19 bp, Artificial sequence
  SiRNA target sequence
tttattcttaagaccgatg

SEQ ID NO: 240098 - DNA, 19 bp, Artificial sequence
  SiRNA target sequence
ttattcttaagaccgatgg

SEQ ID NO: 240099 - DNA, 19 bp, Artificial sequence
  SiRNA target sequence
tattcttaagaccgatgga

SEQ ID NO: 240100 - DNA, 19 bp, Artificial sequence
  SiRNA target sequence
attcttaagaccgatggag

SEQ ID NO: 240101 - DNA, 19 bp, Artificial sequence
  SiRNA target sequence
ttcttaagaccgatggagc

SEQ ID NO: 240102 - DNA, 19 bp, Artificial sequence
  SiRNA target sequence
tcttaagaccgatggagct

SEQ ID NO: 240103 - DNA, 19 bp, Artificial sequence
  SiRNA target sequence
cttaagaccgatggagctg

SEQ ID NO: 240104 - DNA, 19 bp, Artificial sequence
  SiRNA target sequence
ttaagaccgatggagctgt

SEQ ID NO: 240105 - DNA, 19 bp, Artificial sequence
  SiRNA target sequence
taagaccgatggagctgtg

SEQ ID NO: 240106 - DNA, 19 bp, Artificial sequence
  SiRNA target sequence
aagaccgatggagctgtgc

SEQ ID NO: 240107 - DNA, 19 bp, Artificial sequence
  SiRNA target sequence
agaccgatggagctgtgcg

SEQ ID NO: 240108 - DNA, 19 bp, Artificial sequence
  SiRNA target sequence
gaccgatggagctgtgcgc

SEQ ID NO: 240109 - DNA, 19 bp, Artificial sequence
  SiRNA target sequence
accgatggagctgtgcgca

SEQ ID NO: 240110 - DNA, 19 bp, Artificial sequence
  SiRNA target sequence
ccgatggagctgtgcgcaa

SEQ ID NO: 240111 - DNA, 19 bp, Artificial sequence
  SiRNA target sequence
cgatggagctgtgcgcaaa

SEQ ID NO: 240112 - DNA, 19 bp, Artificial sequence
  SiRNA target sequence
gatggagctgtgcgcaaat

SEQ ID NO: 240113 - DNA, 19 bp, Artificial sequence
  SiRNA target sequence
atggagctgtgcgcaaatt

SEQ ID NO: 240114 - DNA, 19 bp, Artificial sequence
  SiRNA target sequence
tggagctgtgcgcaaattg

SEQ ID NO: 240115 - DNA, 19 bp, Artificial sequence
  SiRNA target sequence
ggagctgtgcgcaaattgt

SEQ ID NO: 240116 - DNA, 19 bp, Artificial sequence
  SiRNA target sequence
gagctgtgcgcaaattgta

SEQ ID NO: 240117 - DNA, 19 bp, Artificial sequence
  SiRNA target sequence
agctgtgcgcaaattgtaa

SEQ ID NO: 240118 - DNA, 19 bp, Artificial sequence
  SiRNA target sequence
gctgtgcgcaaattgtaaa

SEQ ID NO: 240119 - DNA, 19 bp, Artificial sequence
  SiRNA target sequence
ctgtgcgcaaattgtaaaa

SEQ ID NO: 240120 - DNA, 19 bp, Artificial sequence
  SiRNA target sequence
tgtgcgcaaattgtaaaaa

SEQ ID NO: 240121 - DNA, 19 bp, Artificial sequence
  SiRNA target sequence
gtgcgcaaattgtaaaaag

SEQ ID NO: 240122 - DNA, 19 bp, Artificial sequence
  SiRNA target sequence
tgcgcaaattgtaaaaaga

SEQ ID NO: 240123 - DNA, 19 bp, Artificial sequence
  SiRNA target sequence
gcgcaaattgtaaaaagaa

SEQ ID NO: 240124 - DNA, 19 bp, Artificial sequence
  SiRNA target sequence
cgcaaattgtaaaaagaaa

SEQ ID NO: 240125 - DNA, 19 bp, Artificial sequence
  SiRNA target sequence
gcaaattgtaaaaagaaag

SEQ ID NO: 240126 - DNA, 19 bp, Artificial sequence
  SiRNA target sequence
caaattgtaaaaagaaagt

SEQ ID NO: 240127 - DNA, 19 bp, Artificial sequence
  SiRNA target sequence
aaattgtaaaaagaaagtc

SEQ ID NO: 240128 - DNA, 19 bp, Artificial sequence
  SiRNA target sequence
aattgtaaaaagaaagtcc

SEQ ID NO: 240129 - DNA, 19 bp, Artificial sequence
  SiRNA target sequence
attgtaaaaagaaagtcct

SEQ ID NO: 240130 - DNA, 19 bp, Artificial sequence
  SiRNA target sequence
ttgtaaaaagaaagtcctg

SEQ ID NO: 240131 - DNA, 19 bp, Artificial sequence
  SiRNA target sequence
tgtaaaaagaaagtcctga

SEQ ID NO: 240132 - DNA, 19 bp, Artificial sequence
  SiRNA target sequence
gtaaaaagaaagtcctgaa

SEQ ID NO: 240133 - DNA, 19 bp, Artificial sequence
  SiRNA target sequence
taaaaagaaagtcctgaaa

SEQ ID NO: 240134 - DNA, 19 bp, Artificial sequence
  SiRNA target sequence
aaaaagaaagtcctgaaat

SEQ ID NO: 240135 - DNA, 19 bp, Artificial sequence
  SiRNA target sequence
aaaagaaagtcctgaaatt

SEQ ID NO: 240136 - DNA, 19 bp, Artificial sequence
  SiRNA target sequence
aaagaaagtcctgaaatta

SEQ ID NO: 240137 - DNA, 19 bp, Artificial sequence
  SiRNA target sequence
aagaaagtcctgaaattag

SEQ ID NO: 240138 - DNA, 19 bp, Artificial sequence
  SiRNA target sequence
agaaagtcctgaaattaga

SEQ ID NO: 240139 - DNA, 19 bp, Artificial sequence
  SiRNA target sequence
gaaagtcctgaaattagag

SEQ ID NO: 240140 - DNA, 19 bp, Artificial sequence
  SiRNA target sequence
aaagtcctgaaattagagc

SEQ ID NO: 240141 - DNA, 19 bp, Artificial sequence
  SiRNA target sequence
aagtcctgaaattagagcg

SEQ ID NO: 240142 - DNA, 19 bp, Artificial sequence
  SiRNA target sequence
agtcctgaaattagagcgg

SEQ ID NO: 240143 - DNA, 19 bp, Artificial sequence
  SiRNA target sequence
gtcctgaaattagagcggt

SEQ ID NO: 240144 - DNA, 19 bp, Artificial sequence
  SiRNA target sequence
tcctgaaattagagcggta

SEQ ID NO: 240145 - DNA, 19 bp, Artificial sequence
  SiRNA target sequence
cctgaaattagagcggtaa

SEQ ID NO: 240146 - DNA, 19 bp, Artificial sequence
  SiRNA target sequence
ctgaaattagagcggtaaa

SEQ ID NO: 240147 - DNA, 19 bp, Artificial sequence
  SiRNA target sequence
tgaaattagagcggtaaaa

SEQ ID NO: 240148 - DNA, 19 bp, Artificial sequence
  SiRNA target sequence
gaaattagagcggtaaaaa

SEQ ID NO: 240149 - DNA, 19 bp, Artificial sequence
  SiRNA target sequence
aaattagagcggtaaaaaa

SEQ ID NO: 240150 - DNA, 19 bp, Artificial sequence
  SiRNA target sequence
aattagagcggtaaaaaat

SEQ ID NO: 240151 - DNA, 19 bp, Artificial sequence
  SiRNA target sequence
attagagcggtaaaaaata

SEQ ID NO: 240152 - DNA, 19 bp, Artificial sequence
  SiRNA target sequence
ttagagcggtaaaaaatat

SEQ ID NO: 240153 - DNA, 19 bp, Artificial sequence
  SiRNA target sequence
tagagcggtaaaaaatata

SEQ ID NO: 240154 - DNA, 19 bp, Artificial sequence
  SiRNA target sequence
agagcggtaaaaaatatag

SEQ ID NO: 240155 - DNA, 19 bp, Artificial sequence
  SiRNA target sequence
gagcggtaaaaaatatagc

SEQ ID NO: 240156 - DNA, 19 bp, Artificial sequence
  SiRNA target sequence
agcggtaaaaaatatagca

SEQ ID NO: 240157 - DNA, 19 bp, Artificial sequence
  SiRNA target sequence
gcggtaaaaaatatagcag

SEQ ID NO: 240158 - DNA, 19 bp, Artificial sequence
  SiRNA target sequence
cggtaaaaaatatagcagc

SEQ ID NO: 240159 - DNA, 19 bp, Artificial sequence
  SiRNA target sequence
ggtaaaaaatatagcagca

SEQ ID NO: 240160 - DNA, 19 bp, Artificial sequence
  SiRNA target sequence
gtaaaaaatatagcagcaa

SEQ ID NO: 240161 - DNA, 19 bp, Artificial sequence
  SiRNA target sequence
taaaaaatatagcagcaat

SEQ ID NO: 240162 - DNA, 19 bp, Artificial sequence
  SiRNA target sequence
aaaaaatatagcagcaata

SEQ ID NO: 240163 - DNA, 19 bp, Artificial sequence
  SiRNA target sequence
aaaaatatagcagcaatag

SEQ ID NO: 240164 - DNA, 19 bp, Artificial sequence
  SiRNA target sequence
aaaatatagcagcaatagg

SEQ ID NO: 240165 - DNA, 19 bp, Artificial sequence
  SiRNA target sequence
aaatatagcagcaataggg

SEQ ID NO: 240166 - DNA, 19 bp, Artificial sequence
  SiRNA target sequence
aatatagcagcaatagggg

SEQ ID NO: 240167 - DNA, 19 bp, Artificial sequence
  SiRNA target sequence
atatagcagcaatagggga

SEQ ID NO: 240168 - DNA, 19 bp, Artificial sequence
  SiRNA target sequence
tatagcagcaataggggag

SEQ ID NO: 240169 - DNA, 19 bp, Artificial sequence
  SiRNA target sequence
atagcagcaataggggagg

SEQ ID NO: 240170 - DNA, 19 bp, Artificial sequence
  SiRNA target sequence
tagcagcaataggggaggc

SEQ ID NO: 240171 - DNA, 19 bp, Artificial sequence
  SiRNA target sequence
agcagcaataggggaggca

SEQ ID NO: 240172 - DNA, 19 bp, Artificial sequence
  SiRNA target sequence
gcagcaataggggaggcaa

SEQ ID NO: 240173 - DNA, 19 bp, Artificial sequence
  SiRNA target sequence
cagcaataggggaggcaat

SEQ ID NO: 240174 - DNA, 19 bp, Artificial sequence
  SiRNA target sequence
agcaataggggaggcaata

SEQ ID NO: 240175 - DNA, 19 bp, Artificial sequence
  SiRNA target sequence
gcaataggggaggcaatag

SEQ ID NO: 240176 - DNA, 19 bp, Artificial sequence
  SiRNA target sequence
caataggggaggcaataga

SEQ ID NO: 240177 - DNA, 19 bp, Artificial sequence
  SiRNA target sequence
aataggggaggcaatagat

SEQ ID NO: 240178 - DNA, 19 bp, Artificial sequence
  SiRNA target sequence
ataggggaggcaatagata

SEQ ID NO: 240179 - DNA, 19 bp, Artificial sequence
  SiRNA target sequence
taggggaggcaatagatag

SEQ ID NO: 240180 - DNA, 19 bp, Artificial sequence
  SiRNA target sequence
aggggaggcaatagataga

SEQ ID NO: 240181 - DNA, 19 bp, Artificial sequence
  SiRNA target sequence
ggggaggcaatagatagat

SEQ ID NO: 240182 - DNA, 19 bp, Artificial sequence
  SiRNA target sequence
gggaggcaatagatagata

SEQ ID NO: 240183 - DNA, 19 bp, Artificial sequence
  SiRNA target sequence
ggaggcaatagatagataa

SEQ ID NO: 240184 - DNA, 19 bp, Artificial sequence
  SiRNA target sequence
gaggcaatagatagataaa

SEQ ID NO: 240185 - DNA, 19 bp, Artificial sequence
  SiRNA target sequence
aggcaatagatagataaaa

SEQ ID NO: 240186 - DNA, 19 bp, Artificial sequence
  SiRNA target sequence
ggcaatagatagataaaag

SEQ ID NO: 240187 - DNA, 19 bp, Artificial sequence
  SiRNA target sequence
gcaatagatagataaaaga

SEQ ID NO: 240188 - DNA, 19 bp, Artificial sequence
  SiRNA target sequence
caatagatagataaaagat

SEQ ID NO: 240189 - DNA, 19 bp, Artificial sequence
  SiRNA target sequence
aatagatagataaaagatc

SEQ ID NO: 240190 - DNA, 19 bp, Artificial sequence
  SiRNA target sequence
atagatagataaaagatcc

SEQ ID NO: 240191 - DNA, 19 bp, Artificial sequence
  SiRNA target sequence
tagatagataaaagatcct

SEQ ID NO: 240192 - DNA, 19 bp, Artificial sequence
  SiRNA target sequence
agatagataaaagatcctt

SEQ ID NO: 240193 - DNA, 19 bp, Artificial sequence
  SiRNA target sequence
gatagataaaagatccttg

SEQ ID NO: 240194 - DNA, 19 bp, Artificial sequence
  SiRNA target sequence
atagataaaagatccttga

SEQ ID NO: 240195 - DNA, 19 bp, Artificial sequence
  SiRNA target sequence
tagataaaagatccttgat

SEQ ID NO: 240196 - DNA, 19 bp, Artificial sequence
  SiRNA target sequence
agataaaagatccttgatg

SEQ ID NO: 240197 - DNA, 19 bp, Artificial sequence
  SiRNA target sequence
gataaaagatccttgatgc

SEQ ID NO: 240198 - DNA, 19 bp, Artificial sequence
  SiRNA target sequence
ataaaagatccttgatgca

SEQ ID NO: 240199 - DNA, 19 bp, Artificial sequence
  SiRNA target sequence
taaaagatccttgatgcaa

SEQ ID NO: 240200 - DNA, 19 bp, Artificial sequence
  SiRNA target sequence
aaaagatccttgatgcaat

SEQ ID NO: 240201 - DNA, 19 bp, Artificial sequence
  SiRNA target sequence
aaagatccttgatgcaatg

SEQ ID NO: 240202 - DNA, 19 bp, Artificial sequence
  SiRNA target sequence
aagatccttgatgcaatgc

SEQ ID NO: 240203 - DNA, 19 bp, Artificial sequence
  SiRNA target sequence
agatccttgatgcaatgcg

SEQ ID NO: 240204 - DNA, 19 bp, Artificial sequence
  SiRNA target sequence
gatccttgatgcaatgcga

SEQ ID NO: 240205 - DNA, 19 bp, Artificial sequence
  SiRNA target sequence
atccttgatgcaatgcgat

SEQ ID NO: 240206 - DNA, 19 bp, Artificial sequence
  SiRNA target sequence
tccttgatgcaatgcgatt

SEQ ID NO: 240207 - DNA, 19 bp, Artificial sequence
  SiRNA target sequence
ccttgatgcaatgcgattt

SEQ ID NO: 240208 - DNA, 19 bp, Artificial sequence
  SiRNA target sequence
cttgatgcaatgcgatttc

SEQ ID NO: 240209 - DNA, 19 bp, Artificial sequence
  SiRNA target sequence
ttgatgcaatgcgatttcc

SEQ ID NO: 240210 - DNA, 19 bp, Artificial sequence
  SiRNA target sequence
tgatgcaatgcgatttcca

SEQ ID NO: 240211 - DNA, 19 bp, Artificial sequence
  SiRNA target sequence
gatgcaatgcgatttccac

SEQ ID NO: 240212 - DNA, 19 bp, Artificial sequence
  SiRNA target sequence
atgcaatgcgatttccacg

SEQ ID NO: 240213 - DNA, 19 bp, Artificial sequence
  SiRNA target sequence
tgcaatgcgatttccacgg

SEQ ID NO: 240214 - DNA, 19 bp, Artificial sequence
  SiRNA target sequence
gcaatgcgatttccacgga

SEQ ID NO: 240215 - DNA, 19 bp, Artificial sequence
  SiRNA target sequence
caatgcgatttccacggat

SEQ ID NO: 240216 - DNA, 19 bp, Artificial sequence
  SiRNA target sequence
aatgcgatttccacggatt

SEQ ID NO: 240217 - DNA, 19 bp, Artificial sequence
  SiRNA target sequence
atgcgatttccacggatta

SEQ ID NO: 240218 - DNA, 19 bp, Artificial sequence
  SiRNA target sequence
tgcgatttccacggattac

SEQ ID NO: 240219 - DNA, 19 bp, Artificial sequence
  SiRNA target sequence
gcgatttccacggattaca

SEQ ID NO: 240220 - DNA, 19 bp, Artificial sequence
  SiRNA target sequence
cgatttccacggattacaa

SEQ ID NO: 240221 - DNA, 19 bp, Artificial sequence
  SiRNA target sequence
gatttccacggattacaaa

SEQ ID NO: 240222 - DNA, 19 bp, Artificial sequence
  SiRNA target sequence
atttccacggattacaaag

SEQ ID NO: 240223 - DNA, 19 bp, Artificial sequence
  SiRNA target sequence
tttccacggattacaaagt

SEQ ID NO: 240224 - DNA, 19 bp, Artificial sequence
  SiRNA target sequence
ttccacggattacaaagtt

SEQ ID NO: 240225 - DNA, 19 bp, Artificial sequence
  SiRNA target sequence
tccacggattacaaagtta

SEQ ID NO: 240226 - DNA, 19 bp, Artificial sequence
  SiRNA target sequence
ccacggattacaaagttat

SEQ ID NO: 240227 - DNA, 19 bp, Artificial sequence
  SiRNA target sequence
cacggattacaaagttata

SEQ ID NO: 240228 - DNA, 19 bp, Artificial sequence
  SiRNA target sequence
acggattacaaagttataa

SEQ ID NO: 240229 - DNA, 19 bp, Artificial sequence
  SiRNA target sequence
cggattacaaagttataaa

SEQ ID NO: 240230 - DNA, 19 bp, Artificial sequence
  SiRNA target sequence
ggattacaaagttataaaa

SEQ ID NO: 240231 - DNA, 19 bp, Artificial sequence
  SiRNA target sequence
gattacaaagttataaaat

SEQ ID NO: 240232 - DNA, 19 bp, Artificial sequence
  SiRNA target sequence
attacaaagttataaaata

SEQ ID NO: 240233 - DNA, 19 bp, Artificial sequence
  SiRNA target sequence
ttacaaagttataaaataa

SEQ ID NO: 240234 - DNA, 19 bp, Artificial sequence
  SiRNA target sequence
tacaaagttataaaataat

SEQ ID NO: 240235 - DNA, 19 bp, Artificial sequence
  SiRNA target sequence
acaaagttataaaataatg

SEQ ID NO: 240236 - DNA, 19 bp, Artificial sequence
  SiRNA target sequence
caaagttataaaataatga

SEQ ID NO: 240237 - DNA, 19 bp, Artificial sequence
  SiRNA target sequence
aaagttataaaataatgat

SEQ ID NO: 240238 - DNA, 19 bp, Artificial sequence
  SiRNA target sequence
aagttataaaataatgata

SEQ ID NO: 240239 - DNA, 19 bp, Artificial sequence
  SiRNA target sequence
agttataaaataatgatac

SEQ ID NO: 240240 - DNA, 19 bp, Artificial sequence
  SiRNA target sequence
gttataaaataatgataca

SEQ ID NO: 240241 - DNA, 19 bp, Artificial sequence
  SiRNA target sequence
ttataaaataatgatacag

SEQ ID NO: 240242 - DNA, 19 bp, Artificial sequence
  SiRNA target sequence
tataaaataatgatacagc

SEQ ID NO: 240243 - DNA, 19 bp, Artificial sequence
  SiRNA target sequence
ataaaataatgatacagca

SEQ ID NO: 240244 - DNA, 19 bp, Artificial sequence
  SiRNA target sequence
taaaataatgatacagcac

SEQ ID NO: 240245 - DNA, 19 bp, Artificial sequence
  SiRNA target sequence
aaaataatgatacagcact

SEQ ID NO: 240246 - DNA, 19 bp, Artificial sequence
  SiRNA target sequence
aaataatgatacagcacta

SEQ ID NO: 240247 - DNA, 19 bp, Artificial sequence
  SiRNA target sequence
aataatgatacagcactaa

SEQ ID NO: 240248 - DNA, 19 bp, Artificial sequence
  SiRNA target sequence
ataatgatacagcactaat

SEQ ID NO: 240249 - DNA, 19 bp, Artificial sequence
  SiRNA target sequence
taatgatacagcactaatc

SEQ ID NO: 240250 - DNA, 19 bp, Artificial sequence
  SiRNA target sequence
aatgatacagcactaatcg

SEQ ID NO: 240251 - DNA, 19 bp, Artificial sequence
  SiRNA target sequence
atgatacagcactaatcgt

SEQ ID NO: 240252 - DNA, 19 bp, Artificial sequence
  SiRNA target sequence
tgatacagcactaatcgtt

SEQ ID NO: 240253 - DNA, 19 bp, Artificial sequence
  SiRNA target sequence
gatacagcactaatcgtta

SEQ ID NO: 240254 - DNA, 19 bp, Artificial sequence
  SiRNA target sequence
atacagcactaatcgttaa

SEQ ID NO: 240255 - DNA, 19 bp, Artificial sequence
  SiRNA target sequence
tacagcactaatcgttaag

SEQ ID NO: 240256 - DNA, 19 bp, Artificial sequence
  SiRNA target sequence
acagcactaatcgttaagg

SEQ ID NO: 240257 - DNA, 19 bp, Artificial sequence
  SiRNA target sequence
cagcactaatcgttaagga

SEQ ID NO: 240258 - DNA, 19 bp, Artificial sequence
  SiRNA target sequence
agcactaatcgttaaggaa

SEQ ID NO: 240259 - DNA, 19 bp, Artificial sequence
  SiRNA target sequence
gcactaatcgttaaggaag

SEQ ID NO: 240260 - DNA, 19 bp, Artificial sequence
  SiRNA target sequence
cactaatcgttaaggaagt

SEQ ID NO: 240261 - DNA, 19 bp, Artificial sequence
  SiRNA target sequence
actaatcgttaaggaagtt

SEQ ID NO: 240262 - DNA, 19 bp, Artificial sequence
  SiRNA target sequence
ctaatcgttaaggaagttg

SEQ ID NO: 240263 - DNA, 19 bp, Artificial sequence
  SiRNA target sequence
taatcgttaaggaagttgt

SEQ ID NO: 240264 - DNA, 19 bp, Artificial sequence
  SiRNA target sequence
aatcgttaaggaagttgtt

SEQ ID NO: 240265 - DNA, 19 bp, Artificial sequence
  SiRNA target sequence
atcgttaaggaagttgtta

SEQ ID NO: 240266 - DNA, 19 bp, Artificial sequence
  SiRNA target sequence
tcgttaaggaagttgttac

SEQ ID NO: 240267 - DNA, 19 bp, Artificial sequence
  SiRNA target sequence
cgttaaggaagttgttact

SEQ ID NO: 240268 - DNA, 19 bp, Artificial sequence
  SiRNA target sequence
gttaaggaagttgttacta

SEQ ID NO: 240269 - DNA, 19 bp, Artificial sequence
  SiRNA target sequence
ttaaggaagttgttactaa

SEQ ID NO: 240270 - DNA, 19 bp, Artificial sequence
  SiRNA target sequence
taaggaagttgttactaaa

SEQ ID NO: 240271 - DNA, 19 bp, Artificial sequence
  SiRNA target sequence
aaggaagttgttactaaat

SEQ ID NO: 240272 - DNA, 19 bp, Artificial sequence
  SiRNA target sequence
aggaagttgttactaaata

SEQ ID NO: 240273 - DNA, 19 bp, Artificial sequence
  SiRNA target sequence
ggaagttgttactaaatat

SEQ ID NO: 240274 - DNA, 19 bp, Artificial sequence
  SiRNA target sequence
gaagttgttactaaatatt

SEQ ID NO: 240275 - DNA, 19 bp, Artificial sequence
  SiRNA target sequence
aagttgttactaaatattt

SEQ ID NO: 240276 - DNA, 19 bp, Artificial sequence
  SiRNA target sequence
agttgttactaaatatttt

SEQ ID NO: 240277 - DNA, 19 bp, Artificial sequence
  SiRNA target sequence
gttgttactaaatattttt

SEQ ID NO: 240278 - DNA, 19 bp, Artificial sequence
  SiRNA target sequence
ttgttactaaatatttttg

SEQ ID NO: 240279 - DNA, 19 bp, Artificial sequence
  SiRNA target sequence
tgttactaaatatttttga

SEQ ID NO: 240280 - DNA, 19 bp, Artificial sequence
  SiRNA target sequence
gttactaaatatttttgag

SEQ ID NO: 240281 - DNA, 19 bp, Artificial sequence
  SiRNA target sequence
ttactaaatatttttgaga

SEQ ID NO: 240282 - DNA, 19 bp, Artificial sequence
  SiRNA target sequence
tactaaatatttttgagaa

SEQ ID NO: 240283 - DNA, 19 bp, Artificial sequence
  SiRNA target sequence
actaaatatttttgagaat

SEQ ID NO: 240284 - DNA, 19 bp, Artificial sequence
  SiRNA target sequence
ctaaatatttttgagaata

SEQ ID NO: 240285 - DNA, 19 bp, Artificial sequence
  SiRNA target sequence
taaatatttttgagaataa

SEQ ID NO: 240286 - DNA, 19 bp, Artificial sequence
  SiRNA target sequence
aaatatttttgagaataat

SEQ ID NO: 240287 - DNA, 19 bp, Artificial sequence
  SiRNA target sequence
aatatttttgagaataatc

SEQ ID NO: 240288 - DNA, 19 bp, Artificial sequence
  SiRNA target sequence
atatttttgagaataatct

SEQ ID NO: 240289 - DNA, 19 bp, Artificial sequence
  SiRNA target sequence
tatttttgagaataatctt

SEQ ID NO: 240290 - DNA, 19 bp, Artificial sequence
  SiRNA target sequence
atttttgagaataatcttt

SEQ ID NO: 240291 - DNA, 19 bp, Artificial sequence
  SiRNA target sequence
tttttgagaataatctttc

SEQ ID NO: 240292 - DNA, 19 bp, Artificial sequence
  SiRNA target sequence
ttttgagaataatctttcg

SEQ ID NO: 240293 - DNA, 19 bp, Artificial sequence
  SiRNA target sequence
tttgagaataatctttcgg

SEQ ID NO: 240294 - DNA, 19 bp, Artificial sequence
  SiRNA target sequence
ttgagaataatctttcgga

SEQ ID NO: 240295 - DNA, 19 bp, Artificial sequence
  SiRNA target sequence
tgagaataatctttcggag

SEQ ID NO: 240296 - DNA, 19 bp, Artificial sequence
  SiRNA target sequence
gagaataatctttcggagg

SEQ ID NO: 240297 - DNA, 19 bp, Artificial sequence
  SiRNA target sequence
agaataatctttcggaggc

SEQ ID NO: 240298 - DNA, 19 bp, Artificial sequence
  SiRNA target sequence
gaataatctttcggaggca

SEQ ID NO: 240299 - DNA, 19 bp, Artificial sequence
  SiRNA target sequence
aataatctttcggaggcat

SEQ ID NO: 240300 - DNA, 19 bp, Artificial sequence
  SiRNA target sequence
ataatctttcggaggcata

SEQ ID NO: 240301 - DNA, 19 bp, Artificial sequence
  SiRNA target sequence
taatctttcggaggcatat

SEQ ID NO: 240302 - DNA, 19 bp, Artificial sequence
  SiRNA target sequence
aatctttcggaggcatatt

SEQ ID NO: 240303 - DNA, 19 bp, Artificial sequence
  SiRNA target sequence
atctttcggaggcatatta

SEQ ID NO: 240304 - DNA, 19 bp, Artificial sequence
  SiRNA target sequence
tctttcggaggcatattat

SEQ ID NO: 240305 - DNA, 19 bp, Artificial sequence
  SiRNA target sequence
ctttcggaggcatattatt

SEQ ID NO: 240306 - DNA, 19 bp, Artificial sequence
  SiRNA target sequence
tttcggaggcatattatta

SEQ ID NO: 240307 - DNA, 19 bp, Artificial sequence
  SiRNA target sequence
ttcggaggcatattattaa

SEQ ID NO: 240308 - DNA, 19 bp, Artificial sequence
  SiRNA target sequence
tcggaggcatattattaat

SEQ ID NO: 240309 - DNA, 19 bp, Artificial sequence
  SiRNA target sequence
cggaggcatattattaatt

SEQ ID NO: 240310 - DNA, 19 bp, Artificial sequence
  SiRNA target sequence
ggaggcatattattaattc

SEQ ID NO: 240311 - DNA, 19 bp, Artificial sequence
  SiRNA target sequence
gaggcatattattaattct

SEQ ID NO: 240312 - DNA, 19 bp, Artificial sequence
  SiRNA target sequence
aggcatattattaattctg

SEQ ID NO: 240313 - DNA, 19 bp, Artificial sequence
  SiRNA target sequence
ggcatattattaattctgc

SEQ ID NO: 240314 - DNA, 19 bp, Artificial sequence
  SiRNA target sequence
gcatattattaattctgct

SEQ ID NO: 240315 - DNA, 19 bp, Artificial sequence
  SiRNA target sequence
catattattaattctgctt

SEQ ID NO: 240316 - DNA, 19 bp, Artificial sequence
  SiRNA target sequence
atattattaattctgcttc

SEQ ID NO: 240317 - DNA, 19 bp, Artificial sequence
  SiRNA target sequence
tattattaattctgcttcc

SEQ ID NO: 240318 - DNA, 19 bp, Artificial sequence
  SiRNA target sequence
attattaattctgcttccc

SEQ ID NO: 240319 - DNA, 19 bp, Artificial sequence
  SiRNA target sequence
ttattaattctgcttcccg

SEQ ID NO: 240320 - DNA, 19 bp, Artificial sequence
  SiRNA target sequence
tattaattctgcttcccgt

SEQ ID NO: 240321 - DNA, 19 bp, Artificial sequence
  SiRNA target sequence
attaattctgcttcccgta

SEQ ID NO: 240322 - DNA, 19 bp, Artificial sequence
  SiRNA target sequence
ttaattctgcttcccgtag

SEQ ID NO: 240323 - DNA, 19 bp, Artificial sequence
  SiRNA target sequence
taattctgcttcccgtaga

SEQ ID NO: 240324 - DNA, 19 bp, Artificial sequence
  SiRNA target sequence
aattctgcttcccgtagat

SEQ ID NO: 240325 - DNA, 19 bp, Artificial sequence
  SiRNA target sequence
attctgcttcccgtagata

SEQ ID NO: 240326 - DNA, 19 bp, Artificial sequence
  SiRNA target sequence
ttctgcttcccgtagataa

SEQ ID NO: 240327 - DNA, 19 bp, Artificial sequence
  SiRNA target sequence
tctgcttcccgtagataaa

SEQ ID NO: 240328 - DNA, 19 bp, Artificial sequence
  SiRNA target sequence
ctgcttcccgtagataaag

SEQ ID NO: 240329 - DNA, 19 bp, Artificial sequence
  SiRNA target sequence
tgcttcccgtagataaaga

SEQ ID NO: 240330 - DNA, 19 bp, Artificial sequence
  SiRNA target sequence
gcttcccgtagataaagaa

SEQ ID NO: 240331 - DNA, 19 bp, Artificial sequence
  SiRNA target sequence
cttcccgtagataaagaat

SEQ ID NO: 240332 - DNA, 19 bp, Artificial sequence
  SiRNA target sequence
ttcccgtagataaagaatt

SEQ ID NO: 240333 - DNA, 19 bp, Artificial sequence
  SiRNA target sequence
tcccgtagataaagaattt

SEQ ID NO: 240334 - DNA, 19 bp, Artificial sequence
  SiRNA target sequence
cccgtagataaagaatttt

SEQ ID NO: 240335 - DNA, 19 bp, Artificial sequence
  SiRNA target sequence
ccgtagataaagaattttt

SEQ ID NO: 240336 - DNA, 19 bp, Artificial sequence
  SiRNA target sequence
cgtagataaagaatttttt

SEQ ID NO: 240337 - DNA, 19 bp, Artificial sequence
  SiRNA target sequence
gtagataaagaatttttta

SEQ ID NO: 240338 - DNA, 19 bp, Artificial sequence
  SiRNA target sequence
tagataaagaattttttaa

SEQ ID NO: 240339 - DNA, 19 bp, Artificial sequence
  SiRNA target sequence
agataaagaattttttaag

SEQ ID NO: 240340 - DNA, 19 bp, Artificial sequence
  SiRNA target sequence
gataaagaattttttaagg

SEQ ID NO: 240341 - DNA, 19 bp, Artificial sequence
  SiRNA target sequence
ataaagaattttttaagga

SEQ ID NO: 240342 - DNA, 19 bp, Artificial sequence
  SiRNA target sequence
taaagaattttttaaggac

SEQ ID NO: 240343 - DNA, 19 bp, Artificial sequence
  SiRNA target sequence
aaagaattttttaaggaca

SEQ ID NO: 240344 - DNA, 19 bp, Artificial sequence
  SiRNA target sequence
aagaattttttaaggacat

SEQ ID NO: 240345 - DNA, 19 bp, Artificial sequence
  SiRNA target sequence
agaattttttaaggacata

SEQ ID NO: 240346 - DNA, 19 bp, Artificial sequence
  SiRNA target sequence
gaattttttaaggacatat

SEQ ID NO: 240347 - DNA, 19 bp, Artificial sequence
  SiRNA target sequence
aattttttaaggacatatc

SEQ ID NO: 240348 - DNA, 19 bp, Artificial sequence
  SiRNA target sequence
attttttaaggacatatca

SEQ ID NO: 240349 - DNA, 19 bp, Artificial sequence
  SiRNA target sequence
ttttttaaggacatatcaa

SEQ ID NO: 240350 - DNA, 19 bp, Artificial sequence
  SiRNA target sequence
tttttaaggacatatcaat

SEQ ID NO: 240351 - DNA, 19 bp, Artificial sequence
  SiRNA target sequence
ttttaaggacatatcaata

SEQ ID NO: 240352 - DNA, 19 bp, Artificial sequence
  SiRNA target sequence
tttaaggacatatcaataa

SEQ ID NO: 240353 - DNA, 19 bp, Artificial sequence
  SiRNA target sequence
ttaaggacatatcaataaa

SEQ ID NO: 240354 - DNA, 19 bp, Artificial sequence
  SiRNA target sequence
taaggacatatcaataaat

SEQ ID NO: 240355 - DNA, 19 bp, Artificial sequence
  SiRNA target sequence
aaggacatatcaataaatc

SEQ ID NO: 240356 - DNA, 19 bp, Artificial sequence
  SiRNA target sequence
aggacatatcaataaatcc

SEQ ID NO: 240357 - DNA, 19 bp, Artificial sequence
  SiRNA target sequence
ggacatatcaataaatcct

SEQ ID NO: 240358 - DNA, 19 bp, Artificial sequence
  SiRNA target sequence
gacatatcaataaatcctg

SEQ ID NO: 240359 - DNA, 19 bp, Artificial sequence
  SiRNA target sequence
acatatcaataaatcctgc

SEQ ID NO: 240360 - DNA, 19 bp, Artificial sequence
  SiRNA target sequence
catatcaataaatcctgca

SEQ ID NO: 240361 - DNA, 19 bp, Artificial sequence
  SiRNA target sequence
atatcaataaatcctgcat

SEQ ID NO: 240362 - DNA, 19 bp, Artificial sequence
  SiRNA target sequence
tatcaataaatcctgcatt

SEQ ID NO: 240363 - DNA, 19 bp, Artificial sequence
  SiRNA target sequence
atcaataaatcctgcatta

SEQ ID NO: 240364 - DNA, 19 bp, Artificial sequence
  SiRNA target sequence
tcaataaatcctgcattaa

SEQ ID NO: 240365 - DNA, 19 bp, Artificial sequence
  SiRNA target sequence
caataaatcctgcattaat

SEQ ID NO: 240366 - DNA, 19 bp, Artificial sequence
  SiRNA target sequence
aataaatcctgcattaata

SEQ ID NO: 240367 - DNA, 19 bp, Artificial sequence
  SiRNA target sequence
ataaatcctgcattaatag

SEQ ID NO: 240368 - DNA, 19 bp, Artificial sequence
  SiRNA target sequence
taaatcctgcattaatagc

SEQ ID NO: 240369 - DNA, 19 bp, Artificial sequence
  SiRNA target sequence
aaatcctgcattaatagca

SEQ ID NO: 240370 - DNA, 19 bp, Artificial sequence
  SiRNA target sequence
aatcctgcattaatagcat

SEQ ID NO: 240371 - DNA, 19 bp, Artificial sequence
  SiRNA target sequence
atcctgcattaatagcata

SEQ ID NO: 240372 - DNA, 19 bp, Artificial sequence
  SiRNA target sequence
tcctgcattaatagcatag

SEQ ID NO: 240373 - DNA, 19 bp, Artificial sequence
  SiRNA target sequence
cctgcattaatagcataga

SEQ ID NO: 240374 - DNA, 19 bp, Artificial sequence
  SiRNA target sequence
ctgcattaatagcatagat

SEQ ID NO: 240375 - DNA, 19 bp, Artificial sequence
  SiRNA target sequence
tgcattaatagcatagatt

SEQ ID NO: 240376 - DNA, 19 bp, Artificial sequence
  SiRNA target sequence
gcattaatagcatagatta

SEQ ID NO: 240377 - DNA, 19 bp, Artificial sequence
  SiRNA target sequence
cattaatagcatagattaa

SEQ ID NO: 240378 - DNA, 19 bp, Artificial sequence
  SiRNA target sequence
attaatagcatagattaat

SEQ ID NO: 240379 - DNA, 19 bp, Artificial sequence
  SiRNA target sequence
ttaatagcatagattaatg

SEQ ID NO: 240380 - DNA, 19 bp, Artificial sequence
  SiRNA target sequence
taatagcatagattaatgc

SEQ ID NO: 240381 - DNA, 19 bp, Artificial sequence
  SiRNA target sequence
aatagcatagattaatgcc

SEQ ID NO: 240382 - DNA, 19 bp, Artificial sequence
  SiRNA target sequence
atagcatagattaatgccg

SEQ ID NO: 240383 - DNA, 19 bp, Artificial sequence
  SiRNA target sequence
tagcatagattaatgccgc

SEQ ID NO: 240384 - DNA, 19 bp, Artificial sequence
  SiRNA target sequence
agcatagattaatgccgct

SEQ ID NO: 240385 - DNA, 19 bp, Artificial sequence
  SiRNA target sequence
gcatagattaatgccgctg

SEQ ID NO: 240386 - DNA, 19 bp, Artificial sequence
  SiRNA target sequence
catagattaatgccgctgc

SEQ ID NO: 240387 - DNA, 19 bp, Artificial sequence
  SiRNA target sequence
atagattaatgccgctgca

SEQ ID NO: 240388 - DNA, 19 bp, Artificial sequence
  SiRNA target sequence
tagattaatgccgctgcac

SEQ ID NO: 240389 - DNA, 19 bp, Artificial sequence
  SiRNA target sequence
agattaatgccgctgcaca

SEQ ID NO: 240390 - DNA, 19 bp, Artificial sequence
  SiRNA target sequence
gattaatgccgctgcacac

SEQ ID NO: 240391 - DNA, 19 bp, Artificial sequence
  SiRNA target sequence
attaatgccgctgcacaca

SEQ ID NO: 240392 - DNA, 19 bp, Artificial sequence
  SiRNA target sequence
ttaatgccgctgcacacat

SEQ ID NO: 240393 - DNA, 19 bp, Artificial sequence
  SiRNA target sequence
taatgccgctgcacacata

SEQ ID NO: 240394 - DNA, 19 bp, Artificial sequence
  SiRNA target sequence
aatgccgctgcacacatat

SEQ ID NO: 240395 - DNA, 19 bp, Artificial sequence
  SiRNA target sequence
atgccgctgcacacatatt

SEQ ID NO: 240396 - DNA, 19 bp, Artificial sequence
  SiRNA target sequence
tgccgctgcacacatattt

SEQ ID NO: 240397 - DNA, 19 bp, Artificial sequence
  SiRNA target sequence
gccgctgcacacatatttc

SEQ ID NO: 240398 - DNA, 19 bp, Artificial sequence
  SiRNA target sequence
ccgctgcacacatatttct

SEQ ID NO: 240399 - DNA, 19 bp, Artificial sequence
  SiRNA target sequence
cgctgcacacatatttctt

SEQ ID NO: 240400 - DNA, 19 bp, Artificial sequence
  SiRNA target sequence
gctgcacacatatttctta

SEQ ID NO: 240401 - DNA, 19 bp, Artificial sequence
  SiRNA target sequence
ctgcacacatatttcttaa

SEQ ID NO: 240402 - DNA, 19 bp, Artificial sequence
  SiRNA target sequence
tgcacacatatttcttaaa

SEQ ID NO: 240403 - DNA, 19 bp, Artificial sequence
  SiRNA target sequence
gcacacatatttcttaaaa

SEQ ID NO: 240404 - DNA, 19 bp, Artificial sequence
  SiRNA target sequence
cacacatatttcttaaaaa

SEQ ID NO: 240405 - DNA, 19 bp, Artificial sequence
  SiRNA target sequence
acacatatttcttaaaaat

SEQ ID NO: 240406 - DNA, 19 bp, Artificial sequence
  SiRNA target sequence
cacatatttcttaaaaatt

SEQ ID NO: 240407 - DNA, 19 bp, Artificial sequence
  SiRNA target sequence
acatatttcttaaaaattt

SEQ ID NO: 240408 - DNA, 19 bp, Artificial sequence
  SiRNA target sequence
catatttcttaaaaatttg

SEQ ID NO: 240409 - DNA, 19 bp, Artificial sequence
  SiRNA target sequence
atatttcttaaaaatttgg

SEQ ID NO: 240410 - DNA, 19 bp, Artificial sequence
  SiRNA target sequence
tatttcttaaaaatttgga

SEQ ID NO: 240411 - DNA, 19 bp, Artificial sequence
  SiRNA target sequence
atttcttaaaaatttggat

SEQ ID NO: 240412 - DNA, 19 bp, Artificial sequence
  SiRNA target sequence
tttcttaaaaatttggatt

SEQ ID NO: 240413 - DNA, 19 bp, Artificial sequence
  SiRNA target sequence
ttcttaaaaatttggattg

SEQ ID NO: 240414 - DNA, 19 bp, Artificial sequence
  SiRNA target sequence
tcttaaaaatttggattgt

SEQ ID NO: 240415 - DNA, 19 bp, Artificial sequence
  SiRNA target sequence
cttaaaaatttggattgta

SEQ ID NO: 240416 - DNA, 19 bp, Artificial sequence
  SiRNA target sequence
ttaaaaatttggattgtaa

SEQ ID NO: 240417 - DNA, 19 bp, Artificial sequence
  SiRNA target sequence
taaaaatttggattgtaaa

SEQ ID NO: 240418 - DNA, 19 bp, Artificial sequence
  SiRNA target sequence
aaaaatttggattgtaaaa

SEQ ID NO: 240419 - DNA, 19 bp, Artificial sequence
  SiRNA target sequence
aaaatttggattgtaaaag

SEQ ID NO: 240420 - DNA, 19 bp, Artificial sequence
  SiRNA target sequence
aaatttggattgtaaaaga

SEQ ID NO: 240421 - DNA, 19 bp, Artificial sequence
  SiRNA target sequence
aatttggattgtaaaagat

SEQ ID NO: 240422 - DNA, 19 bp, Artificial sequence
  SiRNA target sequence
atttggattgtaaaagatc

SEQ ID NO: 240423 - DNA, 19 bp, Artificial sequence
  SiRNA target sequence
tttggattgtaaaagatca

SEQ ID NO: 240424 - DNA, 19 bp, Artificial sequence
  SiRNA target sequence
ttggattgtaaaagatcaa

SEQ ID NO: 240425 - DNA, 19 bp, Artificial sequence
  SiRNA target sequence
tggattgtaaaagatcaaa

SEQ ID NO: 240426 - DNA, 19 bp, Artificial sequence
  SiRNA target sequence
ggattgtaaaagatcaaac

SEQ ID NO: 240427 - DNA, 19 bp, Artificial sequence
  SiRNA target sequence
gattgtaaaagatcaaacg

SEQ ID NO: 240428 - DNA, 19 bp, Artificial sequence
  SiRNA target sequence
attgtaaaagatcaaacga

SEQ ID NO: 240429 - DNA, 19 bp, Artificial sequence
  SiRNA target sequence
ttgtaaaagatcaaacgag

SEQ ID NO: 240430 - DNA, 19 bp, Artificial sequence
  SiRNA target sequence
tgtaaaagatcaaacgagg

SEQ ID NO: 240431 - DNA, 19 bp, Artificial sequence
  SiRNA target sequence
gtaaaagatcaaacgagga

SEQ ID NO: 240432 - DNA, 19 bp, Artificial sequence
  SiRNA target sequence
taaaagatcaaacgaggat

SEQ ID NO: 240433 - DNA, 19 bp, Artificial sequence
  SiRNA target sequence
aaaagatcaaacgaggatg

SEQ ID NO: 240434 - DNA, 19 bp, Artificial sequence
  SiRNA target sequence
aaagatcaaacgaggatgt

SEQ ID NO: 240435 - DNA, 19 bp, Artificial sequence
  SiRNA target sequence
aagatcaaacgaggatgtc

SEQ ID NO: 240436 - DNA, 19 bp, Artificial sequence
  SiRNA target sequence
agatcaaacgaggatgtcg

SEQ ID NO: 240437 - DNA, 19 bp, Artificial sequence
  SiRNA target sequence
gatcaaacgaggatgtcgt

SEQ ID NO: 240438 - DNA, 19 bp, Artificial sequence
  SiRNA target sequence
atcaaacgaggatgtcgtt

SEQ ID NO: 240439 - DNA, 19 bp, Artificial sequence
  SiRNA target sequence
tcaaacgaggatgtcgttt

SEQ ID NO: 240440 - DNA, 19 bp, Artificial sequence
  SiRNA target sequence
caaacgaggatgtcgtttt

SEQ ID NO: 240441 - DNA, 19 bp, Artificial sequence
  SiRNA target sequence
aaacgaggatgtcgttttg

SEQ ID NO: 240442 - DNA, 19 bp, Artificial sequence
  SiRNA target sequence
aacgaggatgtcgttttgt

SEQ ID NO: 240443 - DNA, 19 bp, Artificial sequence
  SiRNA target sequence
acgaggatgtcgttttgtc

SEQ ID NO: 240444 - DNA, 19 bp, Artificial sequence
  SiRNA target sequence
cgaggatgtcgttttgtct

SEQ ID NO: 240445 - DNA, 19 bp, Artificial sequence
  SiRNA target sequence
gaggatgtcgttttgtctt

SEQ ID NO: 240446 - DNA, 19 bp, Artificial sequence
  SiRNA target sequence
aggatgtcgttttgtcttc

SEQ ID NO: 240447 - DNA, 19 bp, Artificial sequence
  SiRNA target sequence
ggatgtcgttttgtcttct

SEQ ID NO: 240448 - DNA, 19 bp, Artificial sequence
  SiRNA target sequence
gatgtcgttttgtcttctt

SEQ ID NO: 240449 - DNA, 19 bp, Artificial sequence
  SiRNA target sequence
atgtcgttttgtcttcttc

SEQ ID NO: 240450 - DNA, 19 bp, Artificial sequence
  SiRNA target sequence
tgtcgttttgtcttcttct

SEQ ID NO: 240451 - DNA, 19 bp, Artificial sequence
  SiRNA target sequence
gtcgttttgtcttcttctt

SEQ ID NO: 240452 - DNA, 19 bp, Artificial sequence
  SiRNA target sequence
tcgttttgtcttcttcttt

SEQ ID NO: 240453 - DNA, 19 bp, Artificial sequence
  SiRNA target sequence
cgttttgtcttcttcttta

SEQ ID NO: 240454 - DNA, 19 bp, Artificial sequence
  SiRNA target sequence
gttttgtcttcttctttat

SEQ ID NO: 240455 - DNA, 19 bp, Artificial sequence
  SiRNA target sequence
ttttgtcttcttctttatt

SEQ ID NO: 240456 - DNA, 19 bp, Artificial sequence
  SiRNA target sequence
tttgtcttcttctttattt

SEQ ID NO: 240457 - DNA, 19 bp, Artificial sequence
  SiRNA target sequence
ttgtcttcttctttattta

SEQ ID NO: 240458 - DNA, 19 bp, Artificial sequence
  SiRNA target sequence
tgtcttcttctttatttat

SEQ ID NO: 240459 - DNA, 19 bp, Artificial sequence
  SiRNA target sequence
gtcttcttctttatttata

SEQ ID NO: 240460 - DNA, 19 bp, Artificial sequence
  SiRNA target sequence
tcttcttctttatttatag

SEQ ID NO: 240461 - DNA, 19 bp, Artificial sequence
  SiRNA target sequence
cttcttctttatttatagt

SEQ ID NO: 240462 - DNA, 19 bp, Artificial sequence
  SiRNA target sequence
ttcttctttatttatagtt

SEQ ID NO: 240463 - DNA, 19 bp, Artificial sequence
  SiRNA target sequence
tcttctttatttatagttt

SEQ ID NO: 240464 - DNA, 19 bp, Artificial sequence
  SiRNA target sequence
cttctttatttatagtttc

SEQ ID NO: 240465 - DNA, 19 bp, Artificial sequence
  SiRNA target sequence
ttctttatttatagtttcc

SEQ ID NO: 240466 - DNA, 19 bp, Artificial sequence
  SiRNA target sequence
tctttatttatagtttcct

SEQ ID NO: 240467 - DNA, 19 bp, Artificial sequence
  SiRNA target sequence
ctttatttatagtttcctt

SEQ ID NO: 240468 - DNA, 19 bp, Artificial sequence
  SiRNA target sequence
tttatttatagtttccttt

SEQ ID NO: 240469 - DNA, 19 bp, Artificial sequence
  SiRNA target sequence
ttatttatagtttccttta

SEQ ID NO: 240470 - DNA, 19 bp, Artificial sequence
  SiRNA target sequence
tatttatagtttcctttat

SEQ ID NO: 240471 - DNA, 19 bp, Artificial sequence
  SiRNA target sequence
atttatagtttcctttatt

SEQ ID NO: 240472 - DNA, 19 bp, Artificial sequence
  SiRNA target sequence
tttatagtttcctttattt

SEQ ID NO: 240473 - DNA, 19 bp, Artificial sequence
  SiRNA target sequence
ttatagtttcctttatttc

SEQ ID NO: 240474 - DNA, 19 bp, Artificial sequence
  SiRNA target sequence
tatagtttcctttatttct

SEQ ID NO: 240475 - DNA, 19 bp, Artificial sequence
  SiRNA target sequence
atagtttcctttatttctt

SEQ ID NO: 240476 - DNA, 19 bp, Artificial sequence
  SiRNA target sequence
tagtttcctttatttcttt

SEQ ID NO: 240477 - DNA, 19 bp, Artificial sequence
  SiRNA target sequence
agtttcctttatttcttta

SEQ ID NO: 240478 - DNA, 19 bp, Artificial sequence
  SiRNA target sequence
gtttcctttatttctttag

SEQ ID NO: 240479 - DNA, 19 bp, Artificial sequence
  SiRNA target sequence
tttcctttatttctttagt

SEQ ID NO: 240480 - DNA, 19 bp, Artificial sequence
  SiRNA target sequence
ttcctttatttctttagtt

SEQ ID NO: 240481 - DNA, 19 bp, Artificial sequence
  SiRNA target sequence
tcctttatttctttagttt

SEQ ID NO: 240482 - DNA, 19 bp, Artificial sequence
  SiRNA target sequence
cctttatttctttagtttt

SEQ ID NO: 240483 - DNA, 19 bp, Artificial sequence
  SiRNA target sequence
ctttatttctttagtttta

SEQ ID NO: 240484 - DNA, 19 bp, Artificial sequence
  SiRNA target sequence
tttatttctttagttttaa

SEQ ID NO: 240485 - DNA, 19 bp, Artificial sequence
  SiRNA target sequence
ttatttctttagttttaag

SEQ ID NO: 240486 - DNA, 19 bp, Artificial sequence
  SiRNA target sequence
tatttctttagttttaaga

SEQ ID NO: 240487 - DNA, 19 bp, Artificial sequence
  SiRNA target sequence
atttctttagttttaagag

SEQ ID NO: 240488 - DNA, 19 bp, Artificial sequence
  SiRNA target sequence
tttctttagttttaagagg

SEQ ID NO: 240489 - DNA, 19 bp, Artificial sequence
  SiRNA target sequence
ttctttagttttaagagga

SEQ ID NO: 240490 - DNA, 19 bp, Artificial sequence
  SiRNA target sequence
tctttagttttaagaggaa

SEQ ID NO: 240491 - DNA, 19 bp, Artificial sequence
  SiRNA target sequence
ctttagttttaagaggaat

SEQ ID NO: 240492 - DNA, 19 bp, Artificial sequence
  SiRNA target sequence
tttagttttaagaggaata

SEQ ID NO: 240493 - DNA, 19 bp, Artificial sequence
  SiRNA target sequence
ttagttttaagaggaatat

SEQ ID NO: 240494 - DNA, 19 bp, Artificial sequence
  SiRNA target sequence
tagttttaagaggaatata

SEQ ID NO: 240495 - DNA, 19 bp, Artificial sequence
  SiRNA target sequence
agttttaagaggaatataa

SEQ ID NO: 240496 - DNA, 19 bp, Artificial sequence
  SiRNA target sequence
gttttaagaggaatataac

SEQ ID NO: 240497 - DNA, 19 bp, Artificial sequence
  SiRNA target sequence
ttttaagaggaatataact

SEQ ID NO: 240498 - DNA, 19 bp, Artificial sequence
  SiRNA target sequence
tttaagaggaatataactt

SEQ ID NO: 240499 - DNA, 19 bp, Artificial sequence
  SiRNA target sequence
ttaagaggaatataacttt

SEQ ID NO: 240500 - DNA, 19 bp, Artificial sequence
  SiRNA target sequence
taagaggaatataactttt

SEQ ID NO: 240501 - DNA, 19 bp, Artificial sequence
  SiRNA target sequence
aagaggaatataacttttt

SEQ ID NO: 240502 - DNA, 19 bp, Artificial sequence
  SiRNA target sequence
agaggaatataacttttta

SEQ ID NO: 240503 - DNA, 19 bp, Artificial sequence
  SiRNA target sequence
gaggaatataactttttaa

SEQ ID NO: 240504 - DNA, 19 bp, Artificial sequence
  SiRNA target sequence
aggaatataactttttaaa

SEQ ID NO: 240505 - DNA, 19 bp, Artificial sequence
  SiRNA target sequence
ggaatataactttttaaaa

SEQ ID NO: 240506 - DNA, 19 bp, Artificial sequence
  SiRNA target sequence
gaatataactttttaaaaa

SEQ ID NO: 240507 - DNA, 19 bp, Artificial sequence
  SiRNA target sequence
aatataactttttaaaaag

SEQ ID NO: 240508 - DNA, 19 bp, Artificial sequence
  SiRNA target sequence
atataactttttaaaaagt

SEQ ID NO: 240509 - DNA, 19 bp, Artificial sequence
  SiRNA target sequence
tataactttttaaaaagta

SEQ ID NO: 240510 - DNA, 19 bp, Artificial sequence
  SiRNA target sequence
ataactttttaaaaagtaa

SEQ ID NO: 240511 - DNA, 19 bp, Artificial sequence
  SiRNA target sequence
taactttttaaaaagtaaa

SEQ ID NO: 240512 - DNA, 19 bp, Artificial sequence
  SiRNA target sequence
aactttttaaaaagtaaat

SEQ ID NO: 240513 - DNA, 19 bp, Artificial sequence
  SiRNA target sequence
actttttaaaaagtaaatt

SEQ ID NO: 240514 - DNA, 19 bp, Artificial sequence
  SiRNA target sequence
ctttttaaaaagtaaatta

SEQ ID NO: 240515 - DNA, 19 bp, Artificial sequence
  SiRNA target sequence
tttttaaaaagtaaattaa

SEQ ID NO: 240516 - DNA, 19 bp, Artificial sequence
  SiRNA target sequence
ttttaaaaagtaaattaat

SEQ ID NO: 240517 - DNA, 19 bp, Artificial sequence
  SiRNA target sequence
tttaaaaagtaaattaatg

SEQ ID NO: 240518 - DNA, 19 bp, Artificial sequence
  SiRNA target sequence
ttaaaaagtaaattaatgt

SEQ ID NO: 240519 - DNA, 19 bp, Artificial sequence
  SiRNA target sequence
taaaaagtaaattaatgta

SEQ ID NO: 240520 - DNA, 19 bp, Artificial sequence
  SiRNA target sequence
aaaaagtaaattaatgtag

SEQ ID NO: 240521 - DNA, 19 bp, Artificial sequence
  SiRNA target sequence
aaaagtaaattaatgtagt

SEQ ID NO: 240522 - DNA, 19 bp, Artificial sequence
  SiRNA target sequence
aaagtaaattaatgtagtt

SEQ ID NO: 240523 - DNA, 19 bp, Artificial sequence
  SiRNA target sequence
aagtaaattaatgtagtta

SEQ ID NO: 240524 - DNA, 19 bp, Artificial sequence
  SiRNA target sequence
agtaaattaatgtagttac

SEQ ID NO: 240525 - DNA, 19 bp, Artificial sequence
  SiRNA target sequence
gtaaattaatgtagttaca

SEQ ID NO: 240526 - DNA, 19 bp, Artificial sequence
  SiRNA target sequence
taaattaatgtagttacaa

SEQ ID NO: 240527 - DNA, 19 bp, Artificial sequence
  SiRNA target sequence
aaattaatgtagttacaaa

SEQ ID NO: 240528 - DNA, 19 bp, Artificial sequence
  SiRNA target sequence
aattaatgtagttacaaaa

SEQ ID NO: 240529 - DNA, 19 bp, Artificial sequence
  SiRNA target sequence
attaatgtagttacaaaag

SEQ ID NO: 240530 - DNA, 19 bp, Artificial sequence
  SiRNA target sequence
ttaatgtagttacaaaaga

SEQ ID NO: 240531 - DNA, 19 bp, Artificial sequence
  SiRNA target sequence
taatgtagttacaaaagac

SEQ ID NO: 240532 - DNA, 19 bp, Artificial sequence
  SiRNA target sequence
aatgtagttacaaaagaca

SEQ ID NO: 240533 - DNA, 19 bp, Artificial sequence
  SiRNA target sequence
atgtagttacaaaagacaa

SEQ ID NO: 240534 - DNA, 19 bp, Artificial sequence
  SiRNA target sequence
tgtagttacaaaagacaag

SEQ ID NO: 240535 - DNA, 19 bp, Artificial sequence
  SiRNA target sequence
gtagttacaaaagacaaga

SEQ ID NO: 240536 - DNA, 19 bp, Artificial sequence
  SiRNA target sequence
tagttacaaaagacaagat

SEQ ID NO: 240537 - DNA, 19 bp, Artificial sequence
  SiRNA target sequence
agttacaaaagacaagatc

SEQ ID NO: 240538 - DNA, 19 bp, Artificial sequence
  SiRNA target sequence
gttacaaaagacaagatca

SEQ ID NO: 240539 - DNA, 19 bp, Artificial sequence
  SiRNA target sequence
ttacaaaagacaagatcaa

SEQ ID NO: 240540 - DNA, 19 bp, Artificial sequence
  SiRNA target sequence
tacaaaagacaagatcaaa

SEQ ID NO: 240541 - DNA, 19 bp, Artificial sequence
  SiRNA target sequence
acaaaagacaagatcaaaa

SEQ ID NO: 240542 - DNA, 19 bp, Artificial sequence
  SiRNA target sequence
caaaagacaagatcaaaaa

SEQ ID NO: 240543 - DNA, 19 bp, Artificial sequence
  SiRNA target sequence
aaaagacaagatcaaaaaa

SEQ ID NO: 240544 - DNA, 19 bp, Artificial sequence
  SiRNA target sequence
aaagacaagatcaaaaaaa

SEQ ID NO: 240545 - DNA, 19 bp, Artificial sequence
  SiRNA target sequence
aagacaagatcaaaaaaaa

SEQ ID NO: 240546 - DNA, 19 bp, Artificial sequence
  SiRNA target sequence
agacaagatcaaaaaaaac

SEQ ID NO: 240547 - DNA, 19 bp, Artificial sequence
  SiRNA target sequence
gacaagatcaaaaaaaaca

SEQ ID NO: 240548 - DNA, 19 bp, Artificial sequence
  SiRNA target sequence
acaagatcaaaaaaaacaa

SEQ ID NO: 240549 - DNA, 19 bp, Artificial sequence
  SiRNA target sequence
caagatcaaaaaaaacaaa

SEQ ID NO: 240550 - DNA, 19 bp, Artificial sequence
  SiRNA target sequence
aagatcaaaaaaaacaaac

SEQ ID NO: 240551 - DNA, 19 bp, Artificial sequence
  SiRNA target sequence
agatcaaaaaaaacaaact

SEQ ID NO: 240552 - DNA, 19 bp, Artificial sequence
  SiRNA target sequence
gatcaaaaaaaacaaacta

SEQ ID NO: 240553 - DNA, 19 bp, Artificial sequence
  SiRNA target sequence
atcaaaaaaaacaaactac

SEQ ID NO: 240554 - DNA, 19 bp, Artificial sequence
  SiRNA target sequence
tcaaaaaaaacaaactact

SEQ ID NO: 240555 - DNA, 19 bp, Artificial sequence
  SiRNA target sequence
caaaaaaaacaaactacta

SEQ ID NO: 240556 - DNA, 19 bp, Artificial sequence
  SiRNA target sequence
aaaaaaaacaaactactac

SEQ ID NO: 240557 - DNA, 19 bp, Artificial sequence
  SiRNA target sequence
aaaaaaacaaactactacc

SEQ ID NO: 240558 - DNA, 19 bp, Artificial sequence
  SiRNA target sequence
aaaaaacaaactactaccg

SEQ ID NO: 240559 - DNA, 19 bp, Artificial sequence
  SiRNA target sequence
aaaaacaaactactaccgt

SEQ ID NO: 240560 - DNA, 19 bp, Artificial sequence
  SiRNA target sequence
aaaacaaactactaccgtc

SEQ ID NO: 240561 - DNA, 19 bp, Artificial sequence
  SiRNA target sequence
aaacaaactactaccgtca

SEQ ID NO: 240562 - DNA, 19 bp, Artificial sequence
  SiRNA target sequence
aacaaactactaccgtcaa

SEQ ID NO: 240563 - DNA, 19 bp, Artificial sequence
  SiRNA target sequence
acaaactactaccgtcaat

SEQ ID NO: 240564 - DNA, 19 bp, Artificial sequence
  SiRNA target sequence
caaactactaccgtcaatt

SEQ ID NO: 240565 - DNA, 19 bp, Artificial sequence
  SiRNA target sequence
aaactactaccgtcaattt

SEQ ID NO: 240566 - DNA, 19 bp, Artificial sequence
  SiRNA target sequence
aactactaccgtcaatttt

SEQ ID NO: 240567 - DNA, 19 bp, Artificial sequence
  SiRNA target sequence
actactaccgtcaatttta

SEQ ID NO: 240568 - DNA, 19 bp, Artificial sequence
  SiRNA target sequence
ctactaccgtcaattttat

SEQ ID NO: 240569 - DNA, 19 bp, Artificial sequence
  SiRNA target sequence
tactaccgtcaattttatc

SEQ ID NO: 240570 - DNA, 19 bp, Artificial sequence
  SiRNA target sequence
actaccgtcaattttatca

SEQ ID NO: 240571 - DNA, 19 bp, Artificial sequence
  SiRNA target sequence
ctaccgtcaattttatcat

SEQ ID NO: 240572 - DNA, 19 bp, Artificial sequence
  SiRNA target sequence
taccgtcaattttatcatg

SEQ ID NO: 240573 - DNA, 19 bp, Artificial sequence
  SiRNA target sequence
accgtcaattttatcatgc

SEQ ID NO: 240574 - DNA, 19 bp, Artificial sequence
  SiRNA target sequence
ccgtcaattttatcatgca

SEQ ID NO: 240575 - DNA, 19 bp, Artificial sequence
  SiRNA target sequence
cgtcaattttatcatgcaa

SEQ ID NO: 240576 - DNA, 19 bp, Artificial sequence
  SiRNA target sequence
gtcaattttatcatgcaaa

SEQ ID NO: 240577 - DNA, 19 bp, Artificial sequence
  SiRNA target sequence
tcaattttatcatgcaaac

SEQ ID NO: 240578 - DNA, 19 bp, Artificial sequence
  SiRNA target sequence
caattttatcatgcaaacc

SEQ ID NO: 240579 - DNA, 19 bp, Artificial sequence
  SiRNA target sequence
aattttatcatgcaaacct

SEQ ID NO: 240580 - DNA, 19 bp, Artificial sequence
  SiRNA target sequence
attttatcatgcaaacctg

SEQ ID NO: 240581 - DNA, 19 bp, Artificial sequence
  SiRNA target sequence
ttttatcatgcaaacctgc

SEQ ID NO: 240582 - DNA, 19 bp, Artificial sequence
  SiRNA target sequence
tttatcatgcaaacctgca

SEQ ID NO: 240583 - DNA, 19 bp, Artificial sequence
  SiRNA target sequence
ttatcatgcaaacctgcag

SEQ ID NO: 240584 - DNA, 19 bp, Artificial sequence
  SiRNA target sequence
tatcatgcaaacctgcagg

SEQ ID NO: 240585 - DNA, 19 bp, Artificial sequence
  SiRNA target sequence
atcatgcaaacctgcagga

SEQ ID NO: 240586 - DNA, 19 bp, Artificial sequence
  SiRNA target sequence
tcatgcaaacctgcaggaa

SEQ ID NO: 240587 - DNA, 19 bp, Artificial sequence
  SiRNA target sequence
catgcaaacctgcaggaag

SEQ ID NO: 240588 - DNA, 19 bp, Artificial sequence
  SiRNA target sequence
atgcaaacctgcaggaagt

SEQ ID NO: 240589 - DNA, 19 bp, Artificial sequence
  SiRNA target sequence
tgcaaacctgcaggaagta

SEQ ID NO: 240590 - DNA, 19 bp, Artificial sequence
  SiRNA target sequence
gcaaacctgcaggaagtat

SEQ ID NO: 240591 - DNA, 19 bp, Artificial sequence
  SiRNA target sequence
caaacctgcaggaagtata

SEQ ID NO: 240592 - DNA, 19 bp, Artificial sequence
  SiRNA target sequence
aaacctgcaggaagtatat

SEQ ID NO: 240593 - DNA, 19 bp, Artificial sequence
  SiRNA target sequence
aacctgcaggaagtatatt

SEQ ID NO: 240594 - DNA, 19 bp, Artificial sequence
  SiRNA target sequence
acctgcaggaagtatattt

SEQ ID NO: 240595 - DNA, 19 bp, Artificial sequence
  SiRNA target sequence
cctgcaggaagtatatttg

SEQ ID NO: 240596 - DNA, 19 bp, Artificial sequence
  SiRNA target sequence
ctgcaggaagtatatttgc

SEQ ID NO: 240597 - DNA, 19 bp, Artificial sequence
  SiRNA target sequence
tgcaggaagtatatttgct

SEQ ID NO: 240598 - DNA, 19 bp, Artificial sequence
  SiRNA target sequence
gcaggaagtatatttgcta

SEQ ID NO: 240599 - DNA, 19 bp, Artificial sequence
  SiRNA target sequence
caggaagtatatttgctaa

SEQ ID NO: 240600 - DNA, 19 bp, Artificial sequence
  SiRNA target sequence
aggaagtatatttgctaat

SEQ ID NO: 240601 - DNA, 19 bp, Artificial sequence
  SiRNA target sequence
ggaagtatatttgctaatt

SEQ ID NO: 240602 - DNA, 19 bp, Artificial sequence
  SiRNA target sequence
gaagtatatttgctaattc

SEQ ID NO: 240603 - DNA, 19 bp, Artificial sequence
  SiRNA target sequence
aagtatatttgctaattca

SEQ ID NO: 240604 - DNA, 19 bp, Artificial sequence
  SiRNA target sequence
agtatatttgctaattcat

SEQ ID NO: 240605 - DNA, 19 bp, Artificial sequence
  SiRNA target sequence
gtatatttgctaattcatc

SEQ ID NO: 240606 - DNA, 19 bp, Artificial sequence
  SiRNA target sequence
tatatttgctaattcatct

SEQ ID NO: 240607 - DNA, 19 bp, Artificial sequence
  SiRNA target sequence
atatttgctaattcatctt

SEQ ID NO: 240608 - DNA, 19 bp, Artificial sequence
  SiRNA target sequence
tatttgctaattcatcttt

SEQ ID NO: 240609 - DNA, 19 bp, Artificial sequence
  SiRNA target sequence
atttgctaattcatctttt

SEQ ID NO: 240610 - DNA, 19 bp, Artificial sequence
  SiRNA target sequence
tttgctaattcatctttta

SEQ ID NO: 240611 - DNA, 19 bp, Artificial sequence
  SiRNA target sequence
ttgctaattcatcttttat

SEQ ID NO: 240612 - DNA, 19 bp, Artificial sequence
  SiRNA target sequence
tgctaattcatcttttata

SEQ ID NO: 240613 - DNA, 19 bp, Artificial sequence
  SiRNA target sequence
gctaattcatcttttatat

SEQ ID NO: 240614 - DNA, 19 bp, Artificial sequence
  SiRNA target sequence
ctaattcatcttttatata

SEQ ID NO: 240615 - DNA, 19 bp, Artificial sequence
  SiRNA target sequence
taattcatcttttatataa

SEQ ID NO: 240616 - DNA, 19 bp, Artificial sequence
  SiRNA target sequence
aattcatcttttatataaa

SEQ ID NO: 240617 - DNA, 19 bp, Artificial sequence
  SiRNA target sequence
attcatcttttatataaat

SEQ ID NO: 240618 - DNA, 19 bp, Artificial sequence
  SiRNA target sequence
ttcatcttttatataaata

SEQ ID NO: 240619 - DNA, 19 bp, Artificial sequence
  SiRNA target sequence
tcatcttttatataaataa

SEQ ID NO: 240620 - DNA, 19 bp, Artificial sequence
  SiRNA target sequence
catcttttatataaataaa

SEQ ID NO: 240621 - DNA, 19 bp, Artificial sequence
  SiRNA target sequence
atcttttatataaataaaa

SEQ ID NO: 240622 - DNA, 19 bp, Artificial sequence
  SiRNA target sequence
tcttttatataaataaaag

SEQ ID NO: 240623 - DNA, 19 bp, Artificial sequence
  SiRNA target sequence
cttttatataaataaaagc

SEQ ID NO: 240624 - DNA, 19 bp, Artificial sequence
  SiRNA target sequence
ttttatataaataaaagct

SEQ ID NO: 240625 - DNA, 19 bp, Artificial sequence
  SiRNA target sequence
tttatataaataaaagcta

SEQ ID NO: 240626 - DNA, 19 bp, Artificial sequence
  SiRNA target sequence
ttatataaataaaagctac

SEQ ID NO: 240627 - DNA, 19 bp, Artificial sequence
  SiRNA target sequence
tatataaataaaagctaca

SEQ ID NO: 240628 - DNA, 19 bp, Artificial sequence
  SiRNA target sequence
atataaataaaagctacag

SEQ ID NO: 240629 - DNA, 19 bp, Artificial sequence
  SiRNA target sequence
tataaataaaagctacaga

SEQ ID NO: 240630 - DNA, 19 bp, Artificial sequence
  SiRNA target sequence
ataaataaaagctacagaa

SEQ ID NO: 240631 - DNA, 19 bp, Artificial sequence
  SiRNA target sequence
taaataaaagctacagaaa

SEQ ID NO: 240632 - DNA, 19 bp, Artificial sequence
  SiRNA target sequence
aaataaaagctacagaaat

SEQ ID NO: 240633 - DNA, 19 bp, Artificial sequence
  SiRNA target sequence
aataaaagctacagaaata

SEQ ID NO: 240634 - DNA, 19 bp, Artificial sequence
  SiRNA target sequence
ataaaagctacagaaataa

SEQ ID NO: 240635 - DNA, 19 bp, Artificial sequence
  SiRNA target sequence
taaaagctacagaaataat

SEQ ID NO: 240636 - DNA, 19 bp, Artificial sequence
  SiRNA target sequence
aaaagctacagaaataatc

SEQ ID NO: 240637 - DNA, 19 bp, Artificial sequence
  SiRNA target sequence
aaagctacagaaataatca

SEQ ID NO: 240638 - DNA, 19 bp, Artificial sequence
  SiRNA target sequence
aagctacagaaataatcat

SEQ ID NO: 240639 - DNA, 19 bp, Artificial sequence
  SiRNA target sequence
agctacagaaataatcatt

SEQ ID NO: 240640 - DNA, 19 bp, Artificial sequence
  SiRNA target sequence
gctacagaaataatcattg

SEQ ID NO: 240641 - DNA, 19 bp, Artificial sequence
  SiRNA target sequence
ctacagaaataatcattga

SEQ ID NO: 240642 - DNA, 19 bp, Artificial sequence
  SiRNA target sequence
tacagaaataatcattgaa

SEQ ID NO: 240643 - DNA, 19 bp, Artificial sequence
  SiRNA target sequence
acagaaataatcattgaaa

SEQ ID NO: 240644 - DNA, 19 bp, Artificial sequence
  SiRNA target sequence
cagaaataatcattgaaat

SEQ ID NO: 240645 - DNA, 19 bp, Artificial sequence
  SiRNA target sequence
agaaataatcattgaaatg

SEQ ID NO: 240646 - DNA, 19 bp, Artificial sequence
  SiRNA target sequence
gaaataatcattgaaatgg

SEQ ID NO: 240647 - DNA, 19 bp, Artificial sequence
  SiRNA target sequence
aaataatcattgaaatggc

SEQ ID NO: 240648 - DNA, 19 bp, Artificial sequence
  SiRNA target sequence
aataatcattgaaatggcg

SEQ ID NO: 240649 - DNA, 19 bp, Artificial sequence
  SiRNA target sequence
ataatcattgaaatggcgg

SEQ ID NO: 240650 - DNA, 19 bp, Artificial sequence
  SiRNA target sequence
taatcattgaaatggcggt

SEQ ID NO: 240651 - DNA, 19 bp, Artificial sequence
  SiRNA target sequence
aatcattgaaatggcggtg

SEQ ID NO: 240652 - DNA, 19 bp, Artificial sequence
  SiRNA target sequence
atcattgaaatggcggtga

SEQ ID NO: 240653 - DNA, 19 bp, Artificial sequence
  SiRNA target sequence
tcattgaaatggcggtgat

SEQ ID NO: 240654 - DNA, 19 bp, Artificial sequence
  SiRNA target sequence
cattgaaatggcggtgatt

SEQ ID NO: 240655 - DNA, 19 bp, Artificial sequence
  SiRNA target sequence
attgaaatggcggtgattg

SEQ ID NO: 240656 - DNA, 19 bp, Artificial sequence
  SiRNA target sequence
ttgaaatggcggtgattgt

SEQ ID NO: 240657 - DNA, 19 bp, Artificial sequence
  SiRNA target sequence
tgaaatggcggtgattgtg

SEQ ID NO: 240658 - DNA, 19 bp, Artificial sequence
  SiRNA target sequence
gaaatggcggtgattgtgg

SEQ ID NO: 240659 - DNA, 19 bp, Artificial sequence
  SiRNA target sequence
aaatggcggtgattgtgga

SEQ ID NO: 240660 - DNA, 19 bp, Artificial sequence
  SiRNA target sequence
aatggcggtgattgtggaa

SEQ ID NO: 240661 - DNA, 19 bp, Artificial sequence
  SiRNA target sequence
atggcggtgattgtggaaa

SEQ ID NO: 240662 - DNA, 19 bp, Artificial sequence
  SiRNA target sequence
tggcggtgattgtggaaaa

SEQ ID NO: 240663 - DNA, 19 bp, Artificial sequence
  SiRNA target sequence
ggcggtgattgtggaaaaa

SEQ ID NO: 240664 - DNA, 19 bp, Artificial sequence
  SiRNA target sequence
gcggtgattgtggaaaaat

SEQ ID NO: 240665 - DNA, 19 bp, Artificial sequence
  SiRNA target sequence
cggtgattgtggaaaaatt

SEQ ID NO: 240666 - DNA, 19 bp, Artificial sequence
  SiRNA target sequence
ggtgattgtggaaaaatta

SEQ ID NO: 240667 - DNA, 19 bp, Artificial sequence
  SiRNA target sequence
gtgattgtggaaaaattag

SEQ ID NO: 240668 - DNA, 19 bp, Artificial sequence
  SiRNA target sequence
tgattgtggaaaaattagg

SEQ ID NO: 240669 - DNA, 19 bp, Artificial sequence
  SiRNA target sequence
gattgtggaaaaattagga

SEQ ID NO: 240670 - DNA, 19 bp, Artificial sequence
  SiRNA target sequence
attgtggaaaaattaggaa

SEQ ID NO: 240671 - DNA, 19 bp, Artificial sequence
  SiRNA target sequence
ttgtggaaaaattaggaac

SEQ ID NO: 240672 - DNA, 19 bp, Artificial sequence
  SiRNA target sequence
tgtggaaaaattaggaaca

SEQ ID NO: 240673 - DNA, 19 bp, Artificial sequence
  SiRNA target sequence
gtggaaaaattaggaacaa

SEQ ID NO: 240674 - DNA, 19 bp, Artificial sequence
  SiRNA target sequence
tggaaaaattaggaacaat

SEQ ID NO: 240675 - DNA, 19 bp, Artificial sequence
  SiRNA target sequence
ggaaaaattaggaacaatt

SEQ ID NO: 240676 - DNA, 19 bp, Artificial sequence
  SiRNA target sequence
gaaaaattaggaacaattt

SEQ ID NO: 240677 - DNA, 19 bp, Artificial sequence
  SiRNA target sequence
aaaaattaggaacaatttc

SEQ ID NO: 240678 - DNA, 19 bp, Artificial sequence
  SiRNA target sequence
aaaattaggaacaatttct

SEQ ID NO: 240679 - DNA, 19 bp, Artificial sequence
  SiRNA target sequence
aaattaggaacaatttctt

SEQ ID NO: 240680 - DNA, 19 bp, Artificial sequence
  SiRNA target sequence
aattaggaacaatttcttt

SEQ ID NO: 240681 - DNA, 19 bp, Artificial sequence
  SiRNA target sequence
attaggaacaatttctttc

SEQ ID NO: 240682 - DNA, 19 bp, Artificial sequence
  SiRNA target sequence
ttaggaacaatttctttca

SEQ ID NO: 240683 - DNA, 19 bp, Artificial sequence
  SiRNA target sequence
taggaacaatttctttcat

SEQ ID NO: 240684 - DNA, 19 bp, Artificial sequence
  SiRNA target sequence
aggaacaatttctttcatt

SEQ ID NO: 240685 - DNA, 19 bp, Artificial sequence
  SiRNA target sequence
ggaacaatttctttcattt

SEQ ID NO: 240686 - DNA, 19 bp, Artificial sequence
  SiRNA target sequence
gaacaatttctttcatttc

SEQ ID NO: 240687 - DNA, 19 bp, Artificial sequence
  SiRNA target sequence
aacaatttctttcatttca

SEQ ID NO: 240688 - DNA, 19 bp, Artificial sequence
  SiRNA target sequence
acaatttctttcatttcat

SEQ ID NO: 240689 - DNA, 19 bp, Artificial sequence
  SiRNA target sequence
caatttctttcatttcatc

SEQ ID NO: 240690 - DNA, 19 bp, Artificial sequence
  SiRNA target sequence
aatttctttcatttcatct

SEQ ID NO: 240691 - DNA, 19 bp, Artificial sequence
  SiRNA target sequence
atttctttcatttcatctt

SEQ ID NO: 240692 - DNA, 19 bp, Artificial sequence
  SiRNA target sequence
tttctttcatttcatcttc

SEQ ID NO: 240693 - DNA, 19 bp, Artificial sequence
  SiRNA target sequence
ttctttcatttcatcttct

SEQ ID NO: 240694 - DNA, 19 bp, Artificial sequence
  SiRNA target sequence
tctttcatttcatcttctg

SEQ ID NO: 240695 - DNA, 19 bp, Artificial sequence
  SiRNA target sequence
ctttcatttcatcttctgt

SEQ ID NO: 240696 - DNA, 19 bp, Artificial sequence
  SiRNA target sequence
tttcatttcatcttctgta

SEQ ID NO: 240697 - DNA, 19 bp, Artificial sequence
  SiRNA target sequence
ttcatttcatcttctgtac

SEQ ID NO: 240698 - DNA, 19 bp, Artificial sequence
  SiRNA target sequence
tcatttcatcttctgtaca

SEQ ID NO: 240699 - DNA, 19 bp, Artificial sequence
  SiRNA target sequence
catttcatcttctgtacaa

SEQ ID NO: 240700 - DNA, 19 bp, Artificial sequence
  SiRNA target sequence
atttcatcttctgtacaag

SEQ ID NO: 240701 - DNA, 19 bp, Artificial sequence
  SiRNA target sequence
tttcatcttctgtacaagc

SEQ ID NO: 240702 - DNA, 19 bp, Artificial sequence
  SiRNA target sequence
ttcatcttctgtacaagca

SEQ ID NO: 240703 - DNA, 19 bp, Artificial sequence
  SiRNA target sequence
tcatcttctgtacaagcat

SEQ ID NO: 240704 - DNA, 19 bp, Artificial sequence
  SiRNA target sequence
catcttctgtacaagcatg

SEQ ID NO: 240705 - DNA, 19 bp, Artificial sequence
  SiRNA target sequence
atcttctgtacaagcatga

SEQ ID NO: 240706 - DNA, 19 bp, Artificial sequence
  SiRNA target sequence
tcttctgtacaagcatgat

SEQ ID NO: 240707 - DNA, 19 bp, Artificial sequence
  SiRNA target sequence
cttctgtacaagcatgatt

SEQ ID NO: 240708 - DNA, 19 bp, Artificial sequence
  SiRNA target sequence
ttctgtacaagcatgattg

SEQ ID NO: 240709 - DNA, 19 bp, Artificial sequence
  SiRNA target sequence
tctgtacaagcatgattgg

SEQ ID NO: 240710 - DNA, 19 bp, Artificial sequence
  SiRNA target sequence
ctgtacaagcatgattggc

SEQ ID NO: 240711 - DNA, 19 bp, Artificial sequence
  SiRNA target sequence
tgtacaagcatgattggct

SEQ ID NO: 240712 - DNA, 19 bp, Artificial sequence
  SiRNA target sequence
gtacaagcatgattggcta

SEQ ID NO: 240713 - DNA, 19 bp, Artificial sequence
  SiRNA target sequence
tacaagcatgattggctaa

SEQ ID NO: 240714 - DNA, 19 bp, Artificial sequence
  SiRNA target sequence
acaagcatgattggctaac

SEQ ID NO: 240715 - DNA, 19 bp, Artificial sequence
  SiRNA target sequence
caagcatgattggctaacg

SEQ ID NO: 240716 - DNA, 19 bp, Artificial sequence
  SiRNA target sequence
aagcatgattggctaacgc

SEQ ID NO: 240717 - DNA, 19 bp, Artificial sequence
  SiRNA target sequence
agcatgattggctaacgca

SEQ ID NO: 240718 - DNA, 19 bp, Artificial sequence
  SiRNA target sequence
gcatgattggctaacgcat

SEQ ID NO: 240719 - DNA, 19 bp, Artificial sequence
  SiRNA target sequence
catgattggctaacgcata

SEQ ID NO: 240720 - DNA, 19 bp, Artificial sequence
  SiRNA target sequence
atgattggctaacgcatat

SEQ ID NO: 240721 - DNA, 19 bp, Artificial sequence
  SiRNA target sequence
tgattggctaacgcatata

SEQ ID NO: 240722 - DNA, 19 bp, Artificial sequence
  SiRNA target sequence
gattggctaacgcatataa

SEQ ID NO: 240723 - DNA, 19 bp, Artificial sequence
  SiRNA target sequence
attggctaacgcatataaa

SEQ ID NO: 240724 - DNA, 19 bp, Artificial sequence
  SiRNA target sequence
ttggctaacgcatataaag

SEQ ID NO: 240725 - DNA, 19 bp, Artificial sequence
  SiRNA target sequence
tggctaacgcatataaagc

SEQ ID NO: 240726 - DNA, 19 bp, Artificial sequence
  SiRNA target sequence
ggctaacgcatataaagca

SEQ ID NO: 240727 - DNA, 19 bp, Artificial sequence
  SiRNA target sequence
gctaacgcatataaagcaa

SEQ ID NO: 240728 - DNA, 19 bp, Artificial sequence
  SiRNA target sequence
ctaacgcatataaagcaaa

SEQ ID NO: 240729 - DNA, 19 bp, Artificial sequence
  SiRNA target sequence
taacgcatataaagcaaaa

SEQ ID NO: 240730 - DNA, 19 bp, Artificial sequence
  SiRNA target sequence
aacgcatataaagcaaaac

SEQ ID NO: 240731 - DNA, 19 bp, Artificial sequence
  SiRNA target sequence
acgcatataaagcaaaacc

SEQ ID NO: 240732 - DNA, 19 bp, Artificial sequence
  SiRNA target sequence
cgcatataaagcaaaacca

SEQ ID NO: 240733 - DNA, 19 bp, Artificial sequence
  SiRNA target sequence
gcatataaagcaaaaccaa

SEQ ID NO: 240734 - DNA, 19 bp, Artificial sequence
  SiRNA target sequence
catataaagcaaaaccaac

SEQ ID NO: 240735 - DNA, 19 bp, Artificial sequence
  SiRNA target sequence
atataaagcaaaaccaact

SEQ ID NO: 240736 - DNA, 19 bp, Artificial sequence
  SiRNA target sequence
tataaagcaaaaccaacta

SEQ ID NO: 240737 - DNA, 19 bp, Artificial sequence
  SiRNA target sequence
ataaagcaaaaccaactac

SEQ ID NO: 240738 - DNA, 19 bp, Artificial sequence
  SiRNA target sequence
taaagcaaaaccaactact

SEQ ID NO: 240739 - DNA, 19 bp, Artificial sequence
  SiRNA target sequence
aaagcaaaaccaactacta

SEQ ID NO: 240740 - DNA, 19 bp, Artificial sequence
  SiRNA target sequence
aagcaaaaccaactactag

SEQ ID NO: 240741 - DNA, 19 bp, Artificial sequence
  SiRNA target sequence
agcaaaaccaactactaga

SEQ ID NO: 240742 - DNA, 19 bp, Artificial sequence
  SiRNA target sequence
gcaaaaccaactactagag

SEQ ID NO: 240743 - DNA, 19 bp, Artificial sequence
  SiRNA target sequence
caaaaccaactactagagt

SEQ ID NO: 240744 - DNA, 19 bp, Artificial sequence
  SiRNA target sequence
aaaaccaactactagagta

SEQ ID NO: 240745 - DNA, 19 bp, Artificial sequence
  SiRNA target sequence
aaaccaactactagagtac

SEQ ID NO: 240746 - DNA, 19 bp, Artificial sequence
  SiRNA target sequence
aaccaactactagagtact

SEQ ID NO: 240747 - DNA, 19 bp, Artificial sequence
  SiRNA target sequence
accaactactagagtactc

SEQ ID NO: 240748 - DNA, 19 bp, Artificial sequence
  SiRNA target sequence
ccaactactagagtactcc

SEQ ID NO: 240749 - DNA, 19 bp, Artificial sequence
  SiRNA target sequence
caactactagagtactcca

SEQ ID NO: 240750 - DNA, 19 bp, Artificial sequence
  SiRNA target sequence
aactactagagtactccac

SEQ ID NO: 240751 - DNA, 19 bp, Artificial sequence
  SiRNA target sequence
actactagagtactccaca

SEQ ID NO: 240752 - DNA, 19 bp, Artificial sequence
  SiRNA target sequence
ctactagagtactccacaa

SEQ ID NO: 240753 - DNA, 19 bp, Artificial sequence
  SiRNA target sequence
tactagagtactccacaac

SEQ ID NO: 240754 - DNA, 19 bp, Artificial sequence
  SiRNA target sequence
actagagtactccacaact

SEQ ID NO: 240755 - DNA, 19 bp, Artificial sequence
  SiRNA target sequence
ctagagtactccacaactc

SEQ ID NO: 240756 - DNA, 19 bp, Artificial sequence
  SiRNA target sequence
tagagtactccacaactcc

SEQ ID NO: 240757 - DNA, 19 bp, Artificial sequence
  SiRNA target sequence
agagtactccacaactccg

SEQ ID NO: 240758 - DNA, 19 bp, Artificial sequence
  SiRNA target sequence
gagtactccacaactccga

SEQ ID NO: 240759 - DNA, 19 bp, Artificial sequence
  SiRNA target sequence
agtactccacaactccgat

SEQ ID NO: 240760 - DNA, 19 bp, Artificial sequence
  SiRNA target sequence
gtactccacaactccgata

SEQ ID NO: 240761 - DNA, 19 bp, Artificial sequence
  SiRNA target sequence
tactccacaactccgataa

SEQ ID NO: 240762 - DNA, 19 bp, Artificial sequence
  SiRNA target sequence
actccacaactccgataag

SEQ ID NO: 240763 - DNA, 19 bp, Artificial sequence
  SiRNA target sequence
ctccacaactccgataaga

SEQ ID NO: 240764 - DNA, 19 bp, Artificial sequence
  SiRNA target sequence
tccacaactccgataagat

SEQ ID NO: 240765 - DNA, 19 bp, Artificial sequence
  SiRNA target sequence
ccacaactccgataagatg

SEQ ID NO: 240766 - DNA, 19 bp, Artificial sequence
  SiRNA target sequence
cacaactccgataagatgt

SEQ ID NO: 240767 - DNA, 19 bp, Artificial sequence
  SiRNA target sequence
acaactccgataagatgta

SEQ ID NO: 240768 - DNA, 19 bp, Artificial sequence
  SiRNA target sequence
caactccgataagatgtaa

SEQ ID NO: 240769 - DNA, 19 bp, Artificial sequence
  SiRNA target sequence
aactccgataagatgtaac

SEQ ID NO: 240770 - DNA, 19 bp, Artificial sequence
  SiRNA target sequence
actccgataagatgtaaca

SEQ ID NO: 240771 - DNA, 19 bp, Artificial sequence
  SiRNA target sequence
ctccgataagatgtaacat

SEQ ID NO: 240772 - DNA, 19 bp, Artificial sequence
  SiRNA target sequence
tccgataagatgtaacata

SEQ ID NO: 240773 - DNA, 19 bp, Artificial sequence
  SiRNA target sequence
ccgataagatgtaacataa

SEQ ID NO: 240774 - DNA, 19 bp, Artificial sequence
  SiRNA target sequence
cgataagatgtaacataaa

SEQ ID NO: 240775 - DNA, 19 bp, Artificial sequence
  SiRNA target sequence
gataagatgtaacataaag

SEQ ID NO: 240776 - DNA, 19 bp, Artificial sequence
  SiRNA target sequence
ataagatgtaacataaagt

SEQ ID NO: 240777 - DNA, 19 bp, Artificial sequence
  SiRNA target sequence
taagatgtaacataaagta

SEQ ID NO: 240778 - DNA, 19 bp, Artificial sequence
  SiRNA target sequence
aagatgtaacataaagtac

SEQ ID NO: 240779 - DNA, 19 bp, Artificial sequence
  SiRNA target sequence
agatgtaacataaagtact

SEQ ID NO: 240780 - DNA, 19 bp, Artificial sequence
  SiRNA target sequence
gatgtaacataaagtactt

SEQ ID NO: 240781 - DNA, 19 bp, Artificial sequence
  SiRNA target sequence
atgtaacataaagtactta

SEQ ID NO: 240782 - DNA, 19 bp, Artificial sequence
  SiRNA target sequence
tgtaacataaagtacttat

SEQ ID NO: 240783 - DNA, 19 bp, Artificial sequence
  SiRNA target sequence
gtaacataaagtacttatc

SEQ ID NO: 240784 - DNA, 19 bp, Artificial sequence
  SiRNA target sequence
taacataaagtacttatcc

SEQ ID NO: 240785 - DNA, 19 bp, Artificial sequence
  SiRNA target sequence
aacataaagtacttatcca

SEQ ID NO: 240786 - DNA, 19 bp, Artificial sequence
  SiRNA target sequence
acataaagtacttatccac

SEQ ID NO: 240787 - DNA, 19 bp, Artificial sequence
  SiRNA target sequence
cataaagtacttatccact

SEQ ID NO: 240788 - DNA, 19 bp, Artificial sequence
  SiRNA target sequence
ataaagtacttatccactc

SEQ ID NO: 240789 - DNA, 19 bp, Artificial sequence
  SiRNA target sequence
taaagtacttatccactca

SEQ ID NO: 240790 - DNA, 19 bp, Artificial sequence
  SiRNA target sequence
aaagtacttatccactcac

SEQ ID NO: 240791 - DNA, 19 bp, Artificial sequence
  SiRNA target sequence
aagtacttatccactcact

SEQ ID NO: 240792 - DNA, 19 bp, Artificial sequence
  SiRNA target sequence
agtacttatccactcactg

SEQ ID NO: 240793 - DNA, 19 bp, Artificial sequence
  SiRNA target sequence
gtacttatccactcactgt

SEQ ID NO: 240794 - DNA, 19 bp, Artificial sequence
  SiRNA target sequence
tacttatccactcactgta

SEQ ID NO: 240795 - DNA, 19 bp, Artificial sequence
  SiRNA target sequence
acttatccactcactgtac

SEQ ID NO: 240796 - DNA, 19 bp, Artificial sequence
  SiRNA target sequence
cttatccactcactgtaca

SEQ ID NO: 240797 - DNA, 19 bp, Artificial sequence
  SiRNA target sequence
ttatccactcactgtacat

SEQ ID NO: 240798 - DNA, 19 bp, Artificial sequence
  SiRNA target sequence
tatccactcactgtacata

SEQ ID NO: 240799 - DNA, 19 bp, Artificial sequence
  SiRNA target sequence
atccactcactgtacatat

SEQ ID NO: 240800 - DNA, 19 bp, Artificial sequence
  SiRNA target sequence
tccactcactgtacatata

SEQ ID NO: 240801 - DNA, 19 bp, Artificial sequence
  SiRNA target sequence
ccactcactgtacatatat

SEQ ID NO: 240802 - DNA, 19 bp, Artificial sequence
  SiRNA target sequence
cactcactgtacatatata

SEQ ID NO: 240803 - DNA, 19 bp, Artificial sequence
  SiRNA target sequence
actcactgtacatatataa

SEQ ID NO: 240804 - DNA, 19 bp, Artificial sequence
  SiRNA target sequence
ctcactgtacatatataaa

SEQ ID NO: 240805 - DNA, 19 bp, Artificial sequence
  SiRNA target sequence
tcactgtacatatataaaa

SEQ ID NO: 240806 - DNA, 19 bp, Artificial sequence
  SiRNA target sequence
cactgtacatatataaaaa

SEQ ID NO: 240807 - DNA, 19 bp, Artificial sequence
  SiRNA target sequence
actgtacatatataaaaaa

SEQ ID NO: 240808 - DNA, 19 bp, Artificial sequence
  SiRNA target sequence
ctgtacatatataaaaaag

SEQ ID NO: 240809 - DNA, 19 bp, Artificial sequence
  SiRNA target sequence
tgtacatatataaaaaagg

SEQ ID NO: 240810 - DNA, 19 bp, Artificial sequence
  SiRNA target sequence
gtacatatataaaaaagga

SEQ ID NO: 240811 - DNA, 19 bp, Artificial sequence
  SiRNA target sequence
tacatatataaaaaaggag

SEQ ID NO: 240812 - DNA, 19 bp, Artificial sequence
  SiRNA target sequence
acatatataaaaaaggaga

SEQ ID NO: 240813 - DNA, 19 bp, Artificial sequence
  SiRNA target sequence
catatataaaaaaggagat

SEQ ID NO: 240814 - DNA, 19 bp, Artificial sequence
  SiRNA target sequence
atatataaaaaaggagata

SEQ ID NO: 240815 - DNA, 19 bp, Artificial sequence
  SiRNA target sequence
tatataaaaaaggagataa

SEQ ID NO: 240816 - DNA, 19 bp, Artificial sequence
  SiRNA target sequence
atataaaaaaggagataag

SEQ ID NO: 240817 - DNA, 19 bp, Artificial sequence
  SiRNA target sequence
tataaaaaaggagataagc

SEQ ID NO: 240818 - DNA, 19 bp, Artificial sequence
  SiRNA target sequence
ataaaaaaggagataagcc

SEQ ID NO: 240819 - DNA, 19 bp, Artificial sequence
  SiRNA target sequence
taaaaaaggagataagccc

SEQ ID NO: 240820 - DNA, 19 bp, Artificial sequence
  SiRNA target sequence
aaaaaaggagataagccca

SEQ ID NO: 240821 - DNA, 19 bp, Artificial sequence
  SiRNA target sequence
aaaaaggagataagcccat

SEQ ID NO: 240822 - DNA, 19 bp, Artificial sequence
  SiRNA target sequence
aaaaggagataagcccatc

SEQ ID NO: 240823 - DNA, 19 bp, Artificial sequence
  SiRNA target sequence
aaaggagataagcccatca

SEQ ID NO: 240824 - DNA, 19 bp, Artificial sequence
  SiRNA target sequence
aaggagataagcccatcaa

SEQ ID NO: 240825 - DNA, 19 bp, Artificial sequence
  SiRNA target sequence
aggagataagcccatcaag

SEQ ID NO: 240826 - DNA, 19 bp, Artificial sequence
  SiRNA target sequence
ggagataagcccatcaagc

SEQ ID NO: 240827 - DNA, 19 bp, Artificial sequence
  SiRNA target sequence
gagataagcccatcaagct

SEQ ID NO: 240828 - DNA, 19 bp, Artificial sequence
  SiRNA target sequence
agataagcccatcaagctt

SEQ ID NO: 240829 - DNA, 19 bp, Artificial sequence
  SiRNA target sequence
gataagcccatcaagcttc

SEQ ID NO: 240830 - DNA, 19 bp, Artificial sequence
  SiRNA target sequence
ataagcccatcaagcttct

SEQ ID NO: 240831 - DNA, 19 bp, Artificial sequence
  SiRNA target sequence
taagcccatcaagcttcta

SEQ ID NO: 240832 - DNA, 19 bp, Artificial sequence
  SiRNA target sequence
aagcccatcaagcttctaa

SEQ ID NO: 240833 - DNA, 19 bp, Artificial sequence
  SiRNA target sequence
agcccatcaagcttctaac

SEQ ID NO: 240834 - DNA, 19 bp, Artificial sequence
  SiRNA target sequence
gcccatcaagcttctaact

SEQ ID NO: 240835 - DNA, 19 bp, Artificial sequence
  SiRNA target sequence
cccatcaagcttctaactg

SEQ ID NO: 240836 - DNA, 19 bp, Artificial sequence
  SiRNA target sequence
ccatcaagcttctaactga

SEQ ID NO: 240837 - DNA, 19 bp, Artificial sequence
  SiRNA target sequence
catcaagcttctaactgac

SEQ ID NO: 240838 - DNA, 19 bp, Artificial sequence
  SiRNA target sequence
atcaagcttctaactgaca

SEQ ID NO: 240839 - DNA, 19 bp, Artificial sequence
  SiRNA target sequence
tcaagcttctaactgacat

SEQ ID NO: 240840 - DNA, 19 bp, Artificial sequence
  SiRNA target sequence
caagcttctaactgacatc

SEQ ID NO: 240841 - DNA, 19 bp, Artificial sequence
  SiRNA target sequence
aagcttctaactgacatct

SEQ ID NO: 240842 - DNA, 19 bp, Artificial sequence
  SiRNA target sequence
agcttctaactgacatctt

SEQ ID NO: 240843 - DNA, 19 bp, Artificial sequence
  SiRNA target sequence
gcttctaactgacatctta

SEQ ID NO: 240844 - DNA, 19 bp, Artificial sequence
  SiRNA target sequence
cttctaactgacatcttac

SEQ ID NO: 240845 - DNA, 19 bp, Artificial sequence
  SiRNA target sequence
ttctaactgacatcttacc

SEQ ID NO: 240846 - DNA, 19 bp, Artificial sequence
  SiRNA target sequence
tctaactgacatcttacca

SEQ ID NO: 240847 - DNA, 19 bp, Artificial sequence
  SiRNA target sequence
ctaactgacatcttaccat

SEQ ID NO: 240848 - DNA, 19 bp, Artificial sequence
  SiRNA target sequence
taactgacatcttaccatc

SEQ ID NO: 240849 - DNA, 19 bp, Artificial sequence
  SiRNA target sequence
aactgacatcttaccatca

SEQ ID NO: 240850 - DNA, 19 bp, Artificial sequence
  SiRNA target sequence
actgacatcttaccatcac

SEQ ID NO: 240851 - DNA, 19 bp, Artificial sequence
  SiRNA target sequence
ctgacatcttaccatcaca

SEQ ID NO: 240852 - DNA, 19 bp, Artificial sequence
  SiRNA target sequence
tgacatcttaccatcacaa

SEQ ID NO: 240853 - DNA, 19 bp, Artificial sequence
  SiRNA target sequence
gacatcttaccatcacaaa

SEQ ID NO: 240854 - DNA, 19 bp, Artificial sequence
  SiRNA target sequence
acatcttaccatcacaaaa

SEQ ID NO: 240855 - DNA, 19 bp, Artificial sequence
  SiRNA target sequence
catcttaccatcacaaaaa

SEQ ID NO: 240856 - DNA, 19 bp, Artificial sequence
  SiRNA target sequence
atcttaccatcacaaaaaa

SEQ ID NO: 240857 - DNA, 19 bp, Artificial sequence
  SiRNA target sequence
tcttaccatcacaaaaaat

SEQ ID NO: 240858 - DNA, 19 bp, Artificial sequence
  SiRNA target sequence
cttaccatcacaaaaaata

SEQ ID NO: 240859 - DNA, 19 bp, Artificial sequence
  SiRNA target sequence
ttaccatcacaaaaaatat

SEQ ID NO: 240860 - DNA, 19 bp, Artificial sequence
  SiRNA target sequence
taccatcacaaaaaatatc

SEQ ID NO: 240861 - DNA, 19 bp, Artificial sequence
  SiRNA target sequence
accatcacaaaaaatatct

SEQ ID NO: 240862 - DNA, 19 bp, Artificial sequence
  SiRNA target sequence
ccatcacaaaaaatatcta

SEQ ID NO: 240863 - DNA, 19 bp, Artificial sequence
  SiRNA target sequence
catcacaaaaaatatctag

SEQ ID NO: 240864 - DNA, 19 bp, Artificial sequence
  SiRNA target sequence
atcacaaaaaatatctagt

SEQ ID NO: 240865 - DNA, 19 bp, Artificial sequence
  SiRNA target sequence
tcacaaaaaatatctagtg

SEQ ID NO: 240866 - DNA, 19 bp, Artificial sequence
  SiRNA target sequence
cacaaaaaatatctagtgc

SEQ ID NO: 240867 - DNA, 19 bp, Artificial sequence
  SiRNA target sequence
acaaaaaatatctagtgcc

SEQ ID NO: 240868 - DNA, 19 bp, Artificial sequence
  SiRNA target sequence
caaaaaatatctagtgccc

SEQ ID NO: 240869 - DNA, 19 bp, Artificial sequence
  SiRNA target sequence
aaaaaatatctagtgccca

SEQ ID NO: 240870 - DNA, 19 bp, Artificial sequence
  SiRNA target sequence
aaaaatatctagtgcccat

SEQ ID NO: 240871 - DNA, 19 bp, Artificial sequence
  SiRNA target sequence
aaaatatctagtgcccatt

SEQ ID NO: 240872 - DNA, 19 bp, Artificial sequence
  SiRNA target sequence
aaatatctagtgcccattg

SEQ ID NO: 240873 - DNA, 19 bp, Artificial sequence
  SiRNA target sequence
aatatctagtgcccattgt

SEQ ID NO: 240874 - DNA, 19 bp, Artificial sequence
  SiRNA target sequence
atatctagtgcccattgtg

SEQ ID NO: 240875 - DNA, 19 bp, Artificial sequence
  SiRNA target sequence
tatctagtgcccattgtga

SEQ ID NO: 240876 - DNA, 19 bp, Artificial sequence
  SiRNA target sequence
atctagtgcccattgtgat

SEQ ID NO: 240877 - DNA, 19 bp, Artificial sequence
  SiRNA target sequence
tctagtgcccattgtgatc

SEQ ID NO: 240878 - DNA, 19 bp, Artificial sequence
  SiRNA target sequence
ctagtgcccattgtgatcc

SEQ ID NO: 240879 - DNA, 19 bp, Artificial sequence
  SiRNA target sequence
tagtgcccattgtgatcct

SEQ ID NO: 240880 - DNA, 19 bp, Artificial sequence
  SiRNA target sequence
agtgcccattgtgatcctt

SEQ ID NO: 240881 - DNA, 19 bp, Artificial sequence
  SiRNA target sequence
gtgcccattgtgatccttt

SEQ ID NO: 240882 - DNA, 19 bp, Artificial sequence
  SiRNA target sequence
tgcccattgtgatcctttt

SEQ ID NO: 240883 - DNA, 19 bp, Artificial sequence
  SiRNA target sequence
gcccattgtgatccttttt

SEQ ID NO: 240884 - DNA, 19 bp, Artificial sequence
  SiRNA target sequence
cccattgtgatcctttttg

SEQ ID NO: 240885 - DNA, 19 bp, Artificial sequence
  SiRNA target sequence
ccattgtgatcctttttgg

SEQ ID NO: 240886 - DNA, 19 bp, Artificial sequence
  SiRNA target sequence
cattgtgatcctttttgga

SEQ ID NO: 240887 - DNA, 19 bp, Artificial sequence
  SiRNA target sequence
attgtgatcctttttggat

SEQ ID NO: 240888 - DNA, 19 bp, Artificial sequence
  SiRNA target sequence
ttgtgatcctttttggatt

SEQ ID NO: 240889 - DNA, 19 bp, Artificial sequence
  SiRNA target sequence
tgtgatcctttttggattt

SEQ ID NO: 240890 - DNA, 19 bp, Artificial sequence
  SiRNA target sequence
gtgatcctttttggatttt

SEQ ID NO: 240891 - DNA, 19 bp, Artificial sequence
  SiRNA target sequence
tgatcctttttggatttta

SEQ ID NO: 240892 - DNA, 19 bp, Artificial sequence
  SiRNA target sequence
gatcctttttggattttat

SEQ ID NO: 240893 - DNA, 19 bp, Artificial sequence
  SiRNA target sequence
atcctttttggattttata

SEQ ID NO: 240894 - DNA, 19 bp, Artificial sequence
  SiRNA target sequence
tcctttttggattttatat

SEQ ID NO: 240895 - DNA, 19 bp, Artificial sequence
  SiRNA target sequence
cctttttggattttatatt

SEQ ID NO: 240896 - DNA, 19 bp, Artificial sequence
  SiRNA target sequence
ctttttggattttatattc

SEQ ID NO: 240897 - DNA, 19 bp, Artificial sequence
  SiRNA target sequence
tttttggattttatattca

SEQ ID NO: 240898 - DNA, 19 bp, Artificial sequence
  SiRNA target sequence
ttttggattttatattcaa

SEQ ID NO: 240899 - DNA, 19 bp, Artificial sequence
  SiRNA target sequence
tttggattttatattcaaa

SEQ ID NO: 240900 - DNA, 19 bp, Artificial sequence
  SiRNA target sequence
ttggattttatattcaaat

SEQ ID NO: 240901 - DNA, 19 bp, Artificial sequence
  SiRNA target sequence
tggattttatattcaaatg

SEQ ID NO: 240902 - DNA, 19 bp, Artificial sequence
  SiRNA target sequence
ggattttatattcaaatgg

SEQ ID NO: 240903 - DNA, 19 bp, Artificial sequence
  SiRNA target sequence
gattttatattcaaatgga

SEQ ID NO: 240904 - DNA, 19 bp, Artificial sequence
  SiRNA target sequence
attttatattcaaatggaa

SEQ ID NO: 240905 - DNA, 19 bp, Artificial sequence
  SiRNA target sequence
ttttatattcaaatggaat

SEQ ID NO: 240906 - DNA, 19 bp, Artificial sequence
  SiRNA target sequence
tttatattcaaatggaatt

SEQ ID NO: 240907 - DNA, 19 bp, Artificial sequence
  SiRNA target sequence
ttatattcaaatggaatta

SEQ ID NO: 240908 - DNA, 19 bp, Artificial sequence
  SiRNA target sequence
tatattcaaatggaattaa

SEQ ID NO: 240909 - DNA, 19 bp, Artificial sequence
  SiRNA target sequence
atattcaaatggaattaaa

SEQ ID NO: 240910 - DNA, 19 bp, Artificial sequence
  SiRNA target sequence
tattcaaatggaattaaaa

SEQ ID NO: 240911 - DNA, 19 bp, Artificial sequence
  SiRNA target sequence
attcaaatggaattaaaag

SEQ ID NO: 240912 - DNA, 19 bp, Artificial sequence
  SiRNA target sequence
ttcaaatggaattaaaaga

SEQ ID NO: 240913 - DNA, 19 bp, Artificial sequence
  SiRNA target sequence
tcaaatggaattaaaagag

SEQ ID NO: 240914 - DNA, 19 bp, Artificial sequence
  SiRNA target sequence
caaatggaattaaaagaga

SEQ ID NO: 240915 - DNA, 19 bp, Artificial sequence
  SiRNA target sequence
aaatggaattaaaagagaa

SEQ ID NO: 240916 - DNA, 19 bp, Artificial sequence
  SiRNA target sequence
aatggaattaaaagagaac

SEQ ID NO: 240917 - DNA, 19 bp, Artificial sequence
  SiRNA target sequence
atggaattaaaagagaacc

SEQ ID NO: 240918 - DNA, 19 bp, Artificial sequence
  SiRNA target sequence
tggaattaaaagagaacca

SEQ ID NO: 240919 - DNA, 19 bp, Artificial sequence
  SiRNA target sequence
ggaattaaaagagaaccaa

SEQ ID NO: 240920 - DNA, 19 bp, Artificial sequence
  SiRNA target sequence
gaattaaaagagaaccaat

SEQ ID NO: 240921 - DNA, 19 bp, Artificial sequence
  SiRNA target sequence
aattaaaagagaaccaatt

SEQ ID NO: 240922 - DNA, 19 bp, Artificial sequence
  SiRNA target sequence
attaaaagagaaccaatta

SEQ ID NO: 240923 - DNA, 19 bp, Artificial sequence
  SiRNA target sequence
ttaaaagagaaccaattag

SEQ ID NO: 240924 - DNA, 19 bp, Artificial sequence
  SiRNA target sequence
taaaagagaaccaattaga

SEQ ID NO: 240925 - DNA, 19 bp, Artificial sequence
  SiRNA target sequence
aaaagagaaccaattagaa

SEQ ID NO: 240926 - DNA, 19 bp, Artificial sequence
  SiRNA target sequence
aaagagaaccaattagaaa

SEQ ID NO: 240927 - DNA, 19 bp, Artificial sequence
  SiRNA target sequence
aagagaaccaattagaaaa

SEQ ID NO: 240928 - DNA, 19 bp, Artificial sequence
  SiRNA target sequence
agagaaccaattagaaaaa

SEQ ID NO: 240929 - DNA, 19 bp, Artificial sequence
  SiRNA target sequence
gagaaccaattagaaaaaa

SEQ ID NO: 240930 - DNA, 19 bp, Artificial sequence
  SiRNA target sequence
agaaccaattagaaaaaaa

SEQ ID NO: 240931 - DNA, 19 bp, Artificial sequence
  SiRNA target sequence
gaaccaattagaaaaaaaa

SEQ ID NO: 240932 - DNA, 19 bp, Artificial sequence
  SiRNA target sequence
aaccaattagaaaaaaaat

SEQ ID NO: 240933 - DNA, 19 bp, Artificial sequence
  SiRNA target sequence
accaattagaaaaaaaatg

SEQ ID NO: 240934 - DNA, 19 bp, Artificial sequence
  SiRNA target sequence
ccaattagaaaaaaaatgc

SEQ ID NO: 240935 - DNA, 19 bp, Artificial sequence
  SiRNA target sequence
caattagaaaaaaaatgcc

SEQ ID NO: 240936 - DNA, 19 bp, Artificial sequence
  SiRNA target sequence
aattagaaaaaaaatgcca

SEQ ID NO: 240937 - DNA, 19 bp, Artificial sequence
  SiRNA target sequence
attagaaaaaaaatgccaa

SEQ ID NO: 240938 - DNA, 19 bp, Artificial sequence
  SiRNA target sequence
ttagaaaaaaaatgccaat

SEQ ID NO: 240939 - DNA, 19 bp, Artificial sequence
  SiRNA target sequence
tagaaaaaaaatgccaata

SEQ ID NO: 240940 - DNA, 19 bp, Artificial sequence
  SiRNA target sequence
agaaaaaaaatgccaataa

SEQ ID NO: 240941 - DNA, 19 bp, Artificial sequence
  SiRNA target sequence
gaaaaaaaatgccaataaa

SEQ ID NO: 240942 - DNA, 19 bp, Artificial sequence
  SiRNA target sequence
aaaaaaaatgccaataaaa

SEQ ID NO: 240943 - DNA, 19 bp, Artificial sequence
  SiRNA target sequence
aaaaaaatgccaataaaac

SEQ ID NO: 240944 - DNA, 19 bp, Artificial sequence
  SiRNA target sequence
aaaaaatgccaataaaacc

SEQ ID NO: 240945 - DNA, 19 bp, Artificial sequence
  SiRNA target sequence
aaaaatgccaataaaacca

SEQ ID NO: 240946 - DNA, 19 bp, Artificial sequence
  SiRNA target sequence
aaaatgccaataaaaccaa

SEQ ID NO: 240947 - DNA, 19 bp, Artificial sequence
  SiRNA target sequence
aaatgccaataaaaccaaa

SEQ ID NO: 240948 - DNA, 19 bp, Artificial sequence
  SiRNA target sequence
aatgccaataaaaccaaaa

SEQ ID NO: 240949 - DNA, 19 bp, Artificial sequence
  SiRNA target sequence
atgccaataaaaccaaaaa

SEQ ID NO: 240950 - DNA, 19 bp, Artificial sequence
  SiRNA target sequence
tgccaataaaaccaaaaat

SEQ ID NO: 240951 - DNA, 19 bp, Artificial sequence
  SiRNA target sequence
gccaataaaaccaaaaata

SEQ ID NO: 240952 - DNA, 19 bp, Artificial sequence
  SiRNA target sequence
ccaataaaaccaaaaataa

SEQ ID NO: 240953 - DNA, 19 bp, Artificial sequence
  SiRNA target sequence
caataaaaccaaaaataat

SEQ ID NO: 240954 - DNA, 19 bp, Artificial sequence
  SiRNA target sequence
aataaaaccaaaaataata

SEQ ID NO: 240955 - DNA, 19 bp, Artificial sequence
  SiRNA target sequence
ataaaaccaaaaataataa

SEQ ID NO: 240956 - DNA, 19 bp, Artificial sequence
  SiRNA target sequence
taaaaccaaaaataataaa

SEQ ID NO: 240957 - DNA, 19 bp, Artificial sequence
  SiRNA target sequence
aaaaccaaaaataataaaa

SEQ ID NO: 240958 - DNA, 19 bp, Artificial sequence
  SiRNA target sequence
aaaccaaaaataataaaat

SEQ ID NO: 240959 - DNA, 19 bp, Artificial sequence
  SiRNA target sequence
aaccaaaaataataaaatt

SEQ ID NO: 240960 - DNA, 19 bp, Artificial sequence
  SiRNA target sequence
accaaaaataataaaattc

SEQ ID NO: 240961 - DNA, 19 bp, Artificial sequence
  SiRNA target sequence
ccaaaaataataaaattca

SEQ ID NO: 240962 - DNA, 19 bp, Artificial sequence
  SiRNA target sequence
caaaaataataaaattcac

SEQ ID NO: 240963 - DNA, 19 bp, Artificial sequence
  SiRNA target sequence
aaaaataataaaattcaca

SEQ ID NO: 240964 - DNA, 19 bp, Artificial sequence
  SiRNA target sequence
aaaataataaaattcacaa

SEQ ID NO: 240965 - DNA, 19 bp, Artificial sequence
  SiRNA target sequence
aaataataaaattcacaat

SEQ ID NO: 240966 - DNA, 19 bp, Artificial sequence
  SiRNA target sequence
aataataaaattcacaata

SEQ ID NO: 240967 - DNA, 19 bp, Artificial sequence
  SiRNA target sequence
ataataaaattcacaatac

SEQ ID NO: 240968 - DNA, 19 bp, Artificial sequence
  SiRNA target sequence
taataaaattcacaatact

SEQ ID NO: 240969 - DNA, 19 bp, Artificial sequence
  SiRNA target sequence
aataaaattcacaatacta

SEQ ID NO: 240970 - DNA, 19 bp, Artificial sequence
  SiRNA target sequence
ataaaattcacaatactaa

SEQ ID NO: 240971 - DNA, 19 bp, Artificial sequence
  SiRNA target sequence
taaaattcacaatactaag

SEQ ID NO: 240972 - DNA, 19 bp, Artificial sequence
  SiRNA target sequence
aaaattcacaatactaaga

SEQ ID NO: 240973 - DNA, 19 bp, Artificial sequence
  SiRNA target sequence
aaattcacaatactaagaa

SEQ ID NO: 240974 - DNA, 19 bp, Artificial sequence
  SiRNA target sequence
aattcacaatactaagaat

SEQ ID NO: 240975 - DNA, 19 bp, Artificial sequence
  SiRNA target sequence
attcacaatactaagaata

SEQ ID NO: 240976 - DNA, 19 bp, Artificial sequence
  SiRNA target sequence
ttcacaatactaagaatag

SEQ ID NO: 240977 - DNA, 19 bp, Artificial sequence
  SiRNA target sequence
tcacaatactaagaataga

SEQ ID NO: 240978 - DNA, 19 bp, Artificial sequence
  SiRNA target sequence
cacaatactaagaatagag

SEQ ID NO: 240979 - DNA, 19 bp, Artificial sequence
  SiRNA target sequence
acaatactaagaatagagt

SEQ ID NO: 240980 - DNA, 19 bp, Artificial sequence
  SiRNA target sequence
caatactaagaatagagta

SEQ ID NO: 240981 - DNA, 19 bp, Artificial sequence
  SiRNA target sequence
aatactaagaatagagtac

SEQ ID NO: 240982 - DNA, 19 bp, Artificial sequence
  SiRNA target sequence
atactaagaatagagtaca

SEQ ID NO: 240983 - DNA, 19 bp, Artificial sequence
  SiRNA target sequence
tactaagaatagagtacac

SEQ ID NO: 240984 - DNA, 19 bp, Artificial sequence
  SiRNA target sequence
actaagaatagagtacaca

SEQ ID NO: 240985 - DNA, 19 bp, Artificial sequence
  SiRNA target sequence
ctaagaatagagtacacat

SEQ ID NO: 240986 - DNA, 19 bp, Artificial sequence
  SiRNA target sequence
taagaatagagtacacatt

SEQ ID NO: 240987 - DNA, 19 bp, Artificial sequence
  SiRNA target sequence
aagaatagagtacacattt

SEQ ID NO: 240988 - DNA, 19 bp, Artificial sequence
  SiRNA target sequence
agaatagagtacacattta

SEQ ID NO: 240989 - DNA, 19 bp, Artificial sequence
  SiRNA target sequence
gaatagagtacacatttaa

SEQ ID NO: 240990 - DNA, 19 bp, Artificial sequence
  SiRNA target sequence
aatagagtacacatttaaa

SEQ ID NO: 240991 - DNA, 19 bp, Artificial sequence
  SiRNA target sequence
atagagtacacatttaaag

SEQ ID NO: 240992 - DNA, 19 bp, Artificial sequence
  SiRNA target sequence
tagagtacacatttaaagc

SEQ ID NO: 240993 - DNA, 19 bp, Artificial sequence
  SiRNA target sequence
agagtacacatttaaagcc

SEQ ID NO: 240994 - DNA, 19 bp, Artificial sequence
  SiRNA target sequence
gagtacacatttaaagcct

SEQ ID NO: 240995 - DNA, 19 bp, Artificial sequence
  SiRNA target sequence
agtacacatttaaagcctt

SEQ ID NO: 240996 - DNA, 19 bp, Artificial sequence
  SiRNA target sequence
gtacacatttaaagccttt

SEQ ID NO: 240997 - DNA, 19 bp, Artificial sequence
  SiRNA target sequence
tacacatttaaagcctttt

SEQ ID NO: 240998 - DNA, 19 bp, Artificial sequence
  SiRNA target sequence
acacatttaaagccttttg

SEQ ID NO: 240999 - DNA, 19 bp, Artificial sequence
  SiRNA target sequence
cacatttaaagccttttgg

SEQ ID NO: 241000 - DNA, 19 bp, Artificial sequence
  SiRNA target sequence
acatttaaagccttttgga

SEQ ID NO: 241001 - DNA, 19 bp, Artificial sequence
  SiRNA target sequence
catttaaagccttttggac

SEQ ID NO: 241002 - DNA, 19 bp, Artificial sequence
  SiRNA target sequence
atttaaagccttttggaca

SEQ ID NO: 241003 - DNA, 19 bp, Artificial sequence
  SiRNA target sequence
tttaaagccttttggacat

SEQ ID NO: 241004 - DNA, 19 bp, Artificial sequence
  SiRNA target sequence
ttaaagccttttggacata

SEQ ID NO: 241005 - DNA, 19 bp, Artificial sequence
  SiRNA target sequence
taaagccttttggacatat

SEQ ID NO: 241006 - DNA, 19 bp, Artificial sequence
  SiRNA target sequence
aaagccttttggacatatg

SEQ ID NO: 241007 - DNA, 19 bp, Artificial sequence
  SiRNA target sequence
aagccttttggacatatga

SEQ ID NO: 241008 - DNA, 19 bp, Artificial sequence
  SiRNA target sequence
agccttttggacatatgac

SEQ ID NO: 241009 - DNA, 19 bp, Artificial sequence
  SiRNA target sequence
gccttttggacatatgaca

SEQ ID NO: 241010 - DNA, 19 bp, Artificial sequence
  SiRNA target sequence
ccttttggacatatgacat

SEQ ID NO: 241011 - DNA, 19 bp, Artificial sequence
  SiRNA target sequence
cttttggacatatgacatc

SEQ ID NO: 241012 - DNA, 19 bp, Artificial sequence
  SiRNA target sequence
ttttggacatatgacatca

SEQ ID NO: 241013 - DNA, 19 bp, Artificial sequence
  SiRNA target sequence
tttggacatatgacatcat

SEQ ID NO: 241014 - DNA, 19 bp, Artificial sequence
  SiRNA target sequence
ttggacatatgacatcata

SEQ ID NO: 241015 - DNA, 19 bp, Artificial sequence
  SiRNA target sequence
tggacatatgacatcataa

SEQ ID NO: 241016 - DNA, 19 bp, Artificial sequence
  SiRNA target sequence
ggacatatgacatcataag

SEQ ID NO: 241017 - DNA, 19 bp, Artificial sequence
  SiRNA target sequence
gacatatgacatcataaga

SEQ ID NO: 241018 - DNA, 19 bp, Artificial sequence
  SiRNA target sequence
acatatgacatcataagac

SEQ ID NO: 241019 - DNA, 19 bp, Artificial sequence
  SiRNA target sequence
catatgacatcataagaca

SEQ ID NO: 241020 - DNA, 19 bp, Artificial sequence
  SiRNA target sequence
atatgacatcataagacat

SEQ ID NO: 241021 - DNA, 19 bp, Artificial sequence
  SiRNA target sequence
tatgacatcataagacata

SEQ ID NO: 241022 - DNA, 19 bp, Artificial sequence
  SiRNA target sequence
atgacatcataagacatat

SEQ ID NO: 241023 - DNA, 19 bp, Artificial sequence
  SiRNA target sequence
tgacatcataagacatata

SEQ ID NO: 241024 - DNA, 19 bp, Artificial sequence
  SiRNA target sequence
gacatcataagacatataa

SEQ ID NO: 241025 - DNA, 19 bp, Artificial sequence
  SiRNA target sequence
acatcataagacatataat

SEQ ID NO: 241026 - DNA, 19 bp, Artificial sequence
  SiRNA target sequence
catcataagacatataatt

SEQ ID NO: 241027 - DNA, 19 bp, Artificial sequence
  SiRNA target sequence
atcataagacatataattg

SEQ ID NO: 241028 - DNA, 19 bp, Artificial sequence
  SiRNA target sequence
tcataagacatataattgg

SEQ ID NO: 241029 - DNA, 19 bp, Artificial sequence
  SiRNA target sequence
cataagacatataattggc

SEQ ID NO: 241030 - DNA, 19 bp, Artificial sequence
  SiRNA target sequence
ataagacatataattggca

SEQ ID NO: 241031 - DNA, 19 bp, Artificial sequence
  SiRNA target sequence
taagacatataattggcag

SEQ ID NO: 241032 - DNA, 19 bp, Artificial sequence
  SiRNA target sequence
aagacatataattggcagt

SEQ ID NO: 241033 - DNA, 19 bp, Artificial sequence
  SiRNA target sequence
agacatataattggcagtg

SEQ ID NO: 241034 - DNA, 19 bp, Artificial sequence
  SiRNA target sequence
gacatataattggcagtga

SEQ ID NO: 241035 - DNA, 19 bp, Artificial sequence
  SiRNA target sequence
acatataattggcagtgaa

SEQ ID NO: 241036 - DNA, 19 bp, Artificial sequence
  SiRNA target sequence
catataattggcagtgaaa

SEQ ID NO: 241037 - DNA, 19 bp, Artificial sequence
  SiRNA target sequence
atataattggcagtgaaaa

SEQ ID NO: 241038 - DNA, 19 bp, Artificial sequence
  SiRNA target sequence
tataattggcagtgaaaag

SEQ ID NO: 241039 - DNA, 19 bp, Artificial sequence
  SiRNA target sequence
ataattggcagtgaaaaga

SEQ ID NO: 241040 - DNA, 19 bp, Artificial sequence
  SiRNA target sequence
taattggcagtgaaaagaa

SEQ ID NO: 241041 - DNA, 19 bp, Artificial sequence
  SiRNA target sequence
aattggcagtgaaaagaaa

SEQ ID NO: 241042 - DNA, 19 bp, Artificial sequence
  SiRNA target sequence
attggcagtgaaaagaaaa

SEQ ID NO: 241043 - DNA, 19 bp, Artificial sequence
  SiRNA target sequence
ttggcagtgaaaagaaaag

SEQ ID NO: 241044 - DNA, 19 bp, Artificial sequence
  SiRNA target sequence
tggcagtgaaaagaaaagc

SEQ ID NO: 241045 - DNA, 19 bp, Artificial sequence
  SiRNA target sequence
ggcagtgaaaagaaaagct

SEQ ID NO: 241046 - DNA, 19 bp, Artificial sequence
  SiRNA target sequence
gcagtgaaaagaaaagctt

SEQ ID NO: 241047 - DNA, 19 bp, Artificial sequence
  SiRNA target sequence
cagtgaaaagaaaagcttt

SEQ ID NO: 241048 - DNA, 19 bp, Artificial sequence
  SiRNA target sequence
agtgaaaagaaaagcttta

SEQ ID NO: 241049 - DNA, 19 bp, Artificial sequence
  SiRNA target sequence
gtgaaaagaaaagctttat

SEQ ID NO: 241050 - DNA, 19 bp, Artificial sequence
  SiRNA target sequence
tgaaaagaaaagctttatg

SEQ ID NO: 241051 - DNA, 19 bp, Artificial sequence
  SiRNA target sequence
gaaaagaaaagctttatgt

SEQ ID NO: 241052 - DNA, 19 bp, Artificial sequence
  SiRNA target sequence
aaaagaaaagctttatgta

SEQ ID NO: 241053 - DNA, 19 bp, Artificial sequence
  SiRNA target sequence
aaagaaaagctttatgtag

SEQ ID NO: 241054 - DNA, 19 bp, Artificial sequence
  SiRNA target sequence
aagaaaagctttatgtagt

SEQ ID NO: 241055 - DNA, 19 bp, Artificial sequence
  SiRNA target sequence
agaaaagctttatgtagta

SEQ ID NO: 241056 - DNA, 19 bp, Artificial sequence
  SiRNA target sequence
gaaaagctttatgtagtac

SEQ ID NO: 241057 - DNA, 19 bp, Artificial sequence
  SiRNA target sequence
aaaagctttatgtagtaca

SEQ ID NO: 241058 - DNA, 19 bp, Artificial sequence
  SiRNA target sequence
aaagctttatgtagtacag

SEQ ID NO: 241059 - DNA, 19 bp, Artificial sequence
  SiRNA target sequence
aagctttatgtagtacagt

SEQ ID NO: 241060 - DNA, 19 bp, Artificial sequence
  SiRNA target sequence
agctttatgtagtacagtg

SEQ ID NO: 241061 - DNA, 19 bp, Artificial sequence
  SiRNA target sequence
gctttatgtagtacagtga

SEQ ID NO: 241062 - DNA, 19 bp, Artificial sequence
  SiRNA target sequence
ctttatgtagtacagtgac

SEQ ID NO: 241063 - DNA, 19 bp, Artificial sequence
  SiRNA target sequence
tttatgtagtacagtgacg

SEQ ID NO: 241064 - DNA, 19 bp, Artificial sequence
  SiRNA target sequence
ttatgtagtacagtgacga

SEQ ID NO: 241065 - DNA, 19 bp, Artificial sequence
  SiRNA target sequence
tatgtagtacagtgacgaa

SEQ ID NO: 241066 - DNA, 19 bp, Artificial sequence
  SiRNA target sequence
atgtagtacagtgacgaag

SEQ ID NO: 241067 - DNA, 19 bp, Artificial sequence
  SiRNA target sequence
tgtagtacagtgacgaagg

SEQ ID NO: 241068 - DNA, 19 bp, Artificial sequence
  SiRNA target sequence
gtagtacagtgacgaagga

SEQ ID NO: 241069 - DNA, 19 bp, Artificial sequence
  SiRNA target sequence
tagtacagtgacgaaggaa

SEQ ID NO: 241070 - DNA, 19 bp, Artificial sequence
  SiRNA target sequence
agtacagtgacgaaggaat

SEQ ID NO: 241071 - DNA, 19 bp, Artificial sequence
  SiRNA target sequence
gtacagtgacgaaggaatt

SEQ ID NO: 241072 - DNA, 19 bp, Artificial sequence
  SiRNA target sequence
tacagtgacgaaggaattt

SEQ ID NO: 241073 - DNA, 19 bp, Artificial sequence
  SiRNA target sequence
acagtgacgaaggaatttg

SEQ ID NO: 241074 - DNA, 19 bp, Artificial sequence
  SiRNA target sequence
cagtgacgaaggaatttgt

SEQ ID NO: 241075 - DNA, 19 bp, Artificial sequence
  SiRNA target sequence
agtgacgaaggaatttgtt

SEQ ID NO: 241076 - DNA, 19 bp, Artificial sequence
  SiRNA target sequence
gtgacgaaggaatttgttt

SEQ ID NO: 241077 - DNA, 19 bp, Artificial sequence
  SiRNA target sequence
tgacgaaggaatttgtttt

SEQ ID NO: 241078 - DNA, 19 bp, Artificial sequence
  SiRNA target sequence
gacgaaggaatttgttttg

SEQ ID NO: 241079 - DNA, 19 bp, Artificial sequence
  SiRNA target sequence
acgaaggaatttgttttgt

SEQ ID NO: 241080 - DNA, 19 bp, Artificial sequence
  SiRNA target sequence
cgaaggaatttgttttgtc

SEQ ID NO: 241081 - DNA, 19 bp, Artificial sequence
  SiRNA target sequence
gaaggaatttgttttgtca

SEQ ID NO: 241082 - DNA, 19 bp, Artificial sequence
  SiRNA target sequence
aaggaatttgttttgtcat

SEQ ID NO: 241083 - DNA, 19 bp, Artificial sequence
  SiRNA target sequence
aggaatttgttttgtcata

SEQ ID NO: 241084 - DNA, 19 bp, Artificial sequence
  SiRNA target sequence
ggaatttgttttgtcataa

SEQ ID NO: 241085 - DNA, 19 bp, Artificial sequence
  SiRNA target sequence
gaatttgttttgtcataat

SEQ ID NO: 241086 - DNA, 19 bp, Artificial sequence
  SiRNA target sequence
aatttgttttgtcataatc

SEQ ID NO: 241087 - DNA, 19 bp, Artificial sequence
  SiRNA target sequence
atttgttttgtcataatca

SEQ ID NO: 241088 - DNA, 19 bp, Artificial sequence
  SiRNA target sequence
tttgttttgtcataatcac

SEQ ID NO: 241089 - DNA, 19 bp, Artificial sequence
  SiRNA target sequence
ttgttttgtcataatcacg

SEQ ID NO: 241090 - DNA, 19 bp, Artificial sequence
  SiRNA target sequence
tgttttgtcataatcacga

SEQ ID NO: 241091 - DNA, 19 bp, Artificial sequence
  SiRNA target sequence
gttttgtcataatcacgat

SEQ ID NO: 241092 - DNA, 19 bp, Artificial sequence
  SiRNA target sequence
ttttgtcataatcacgatt

SEQ ID NO: 241093 - DNA, 19 bp, Artificial sequence
  SiRNA target sequence
tttgtcataatcacgattt

SEQ ID NO: 241094 - DNA, 19 bp, Artificial sequence
  SiRNA target sequence
ttgtcataatcacgatttc

SEQ ID NO: 241095 - DNA, 19 bp, Artificial sequence
  SiRNA target sequence
tgtcataatcacgatttct

SEQ ID NO: 241096 - DNA, 19 bp, Artificial sequence
  SiRNA target sequence
gtcataatcacgatttctc

SEQ ID NO: 241097 - DNA, 19 bp, Artificial sequence
  SiRNA target sequence
tcataatcacgatttctct

SEQ ID NO: 241098 - DNA, 19 bp, Artificial sequence
  SiRNA target sequence
cataatcacgatttctctg

SEQ ID NO: 241099 - DNA, 19 bp, Artificial sequence
  SiRNA target sequence
ataatcacgatttctctgt

SEQ ID NO: 241100 - DNA, 19 bp, Artificial sequence
  SiRNA target sequence
taatcacgatttctctgta

SEQ ID NO: 241101 - DNA, 19 bp, Artificial sequence
  SiRNA target sequence
aatcacgatttctctgtaa

SEQ ID NO: 241102 - DNA, 19 bp, Artificial sequence
  SiRNA target sequence
atcacgatttctctgtaaa

SEQ ID NO: 241103 - DNA, 19 bp, Artificial sequence
  SiRNA target sequence
tcacgatttctctgtaaaa

SEQ ID NO: 241104 - DNA, 19 bp, Artificial sequence
  SiRNA target sequence
cacgatttctctgtaaaat

SEQ ID NO: 241105 - DNA, 19 bp, Artificial sequence
  SiRNA target sequence
acgatttctctgtaaaatt

SEQ ID NO: 241106 - DNA, 19 bp, Artificial sequence
  SiRNA target sequence
cgatttctctgtaaaattc

SEQ ID NO: 241107 - DNA, 19 bp, Artificial sequence
  SiRNA target sequence
gatttctctgtaaaattcc

SEQ ID NO: 241108 - DNA, 19 bp, Artificial sequence
  SiRNA target sequence
atttctctgtaaaattcca

SEQ ID NO: 241109 - DNA, 19 bp, Artificial sequence
  SiRNA target sequence
tttctctgtaaaattccaa

SEQ ID NO: 241110 - DNA, 19 bp, Artificial sequence
  SiRNA target sequence
ttctctgtaaaattccaat

SEQ ID NO: 241111 - DNA, 19 bp, Artificial sequence
  SiRNA target sequence
tctctgtaaaattccaata

SEQ ID NO: 241112 - DNA, 19 bp, Artificial sequence
  SiRNA target sequence
ctctgtaaaattccaataa

SEQ ID NO: 241113 - DNA, 19 bp, Artificial sequence
  SiRNA target sequence
tctgtaaaattccaataat

SEQ ID NO: 241114 - DNA, 19 bp, Artificial sequence
  SiRNA target sequence
ctgtaaaattccaataatg

SEQ ID NO: 241115 - DNA, 19 bp, Artificial sequence
  SiRNA target sequence
tgtaaaattccaataatgt

SEQ ID NO: 241116 - DNA, 19 bp, Artificial sequence
  SiRNA target sequence
gtaaaattccaataatgtg

SEQ ID NO: 241117 - DNA, 19 bp, Artificial sequence
  SiRNA target sequence
taaaattccaataatgtgt

SEQ ID NO: 241118 - DNA, 19 bp, Artificial sequence
  SiRNA target sequence
aaaattccaataatgtgtt

SEQ ID NO: 241119 - DNA, 19 bp, Artificial sequence
  SiRNA target sequence
aaattccaataatgtgtta

SEQ ID NO: 241120 - DNA, 19 bp, Artificial sequence
  SiRNA target sequence
aattccaataatgtgttaa

SEQ ID NO: 241121 - DNA, 19 bp, Artificial sequence
  SiRNA target sequence
attccaataatgtgttaat

SEQ ID NO: 241122 - DNA, 19 bp, Artificial sequence
  SiRNA target sequence
ttccaataatgtgttaatc

SEQ ID NO: 241123 - DNA, 19 bp, Artificial sequence
  SiRNA target sequence
tccaataatgtgttaatca

SEQ ID NO: 241124 - DNA, 19 bp, Artificial sequence
  SiRNA target sequence
ccaataatgtgttaatcac

SEQ ID NO: 241125 - DNA, 19 bp, Artificial sequence
  SiRNA target sequence
caataatgtgttaatcaca

SEQ ID NO: 241126 - DNA, 19 bp, Artificial sequence
  SiRNA target sequence
aataatgtgttaatcacac

SEQ ID NO: 241127 - DNA, 19 bp, Artificial sequence
  SiRNA target sequence
ataatgtgttaatcacaca

SEQ ID NO: 241128 - DNA, 19 bp, Artificial sequence
  SiRNA target sequence
taatgtgttaatcacacat

SEQ ID NO: 241129 - DNA, 19 bp, Artificial sequence
  SiRNA target sequence
aatgtgttaatcacacatg

SEQ ID NO: 241130 - DNA, 19 bp, Artificial sequence
  SiRNA target sequence
atgtgttaatcacacatgc

SEQ ID NO: 241131 - DNA, 19 bp, Artificial sequence
  SiRNA target sequence
tgtgttaatcacacatgcc

SEQ ID NO: 241132 - DNA, 19 bp, Artificial sequence
  SiRNA target sequence
gtgttaatcacacatgcca

SEQ ID NO: 241133 - DNA, 19 bp, Artificial sequence
  SiRNA target sequence
tgttaatcacacatgccat

SEQ ID NO: 241134 - DNA, 19 bp, Artificial sequence
  SiRNA target sequence
gttaatcacacatgccatt

SEQ ID NO: 241135 - DNA, 19 bp, Artificial sequence
  SiRNA target sequence
ttaatcacacatgccatta

SEQ ID NO: 241136 - DNA, 19 bp, Artificial sequence
  SiRNA target sequence
taatcacacatgccattaa

SEQ ID NO: 241137 - DNA, 19 bp, Artificial sequence
  SiRNA target sequence
aatcacacatgccattaaa

SEQ ID NO: 241138 - DNA, 19 bp, Artificial sequence
  SiRNA target sequence
atcacacatgccattaaaa

SEQ ID NO: 241139 - DNA, 19 bp, Artificial sequence
  SiRNA target sequence
tcacacatgccattaaaaa

SEQ ID NO: 241140 - DNA, 19 bp, Artificial sequence
  SiRNA target sequence
cacacatgccattaaaaat

SEQ ID NO: 241141 - DNA, 19 bp, Artificial sequence
  SiRNA target sequence
acacatgccattaaaaatg

SEQ ID NO: 241142 - DNA, 19 bp, Artificial sequence
  SiRNA target sequence
cacatgccattaaaaatgt

SEQ ID NO: 241143 - DNA, 19 bp, Artificial sequence
  SiRNA target sequence
acatgccattaaaaatgta

SEQ ID NO: 241144 - DNA, 19 bp, Artificial sequence
  SiRNA target sequence
catgccattaaaaatgtaa

SEQ ID NO: 241145 - DNA, 19 bp, Artificial sequence
  SiRNA target sequence
atgccattaaaaatgtaag

SEQ ID NO: 241146 - DNA, 19 bp, Artificial sequence
  SiRNA target sequence
tgccattaaaaatgtaagt

SEQ ID NO: 241147 - DNA, 19 bp, Artificial sequence
  SiRNA target sequence
gccattaaaaatgtaagtg

SEQ ID NO: 241148 - DNA, 19 bp, Artificial sequence
  SiRNA target sequence
ccattaaaaatgtaagtga

SEQ ID NO: 241149 - DNA, 19 bp, Artificial sequence
  SiRNA target sequence
cattaaaaatgtaagtgac

SEQ ID NO: 241150 - DNA, 19 bp, Artificial sequence
  SiRNA target sequence
attaaaaatgtaagtgaca

SEQ ID NO: 241151 - DNA, 19 bp, Artificial sequence
  SiRNA target sequence
ttaaaaatgtaagtgacaa

SEQ ID NO: 241152 - DNA, 19 bp, Artificial sequence
  SiRNA target sequence
taaaaatgtaagtgacaat

SEQ ID NO: 241153 - DNA, 19 bp, Artificial sequence
  SiRNA target sequence
aaaaatgtaagtgacaata

SEQ ID NO: 241154 - DNA, 19 bp, Artificial sequence
  SiRNA target sequence
aaaatgtaagtgacaataa

SEQ ID NO: 241155 - DNA, 19 bp, Artificial sequence
  SiRNA target sequence
aaatgtaagtgacaataat

SEQ ID NO: 241156 - DNA, 19 bp, Artificial sequence
  SiRNA target sequence
aatgtaagtgacaataata

SEQ ID NO: 241157 - DNA, 19 bp, Artificial sequence
  SiRNA target sequence
atgtaagtgacaataatat

SEQ ID NO: 241158 - DNA, 19 bp, Artificial sequence
  SiRNA target sequence
tgtaagtgacaataatatt

SEQ ID NO: 241159 - DNA, 19 bp, Artificial sequence
  SiRNA target sequence
gtaagtgacaataatattt

SEQ ID NO: 241160 - DNA, 19 bp, Artificial sequence
  SiRNA target sequence
taagtgacaataatatttt

SEQ ID NO: 241161 - DNA, 19 bp, Artificial sequence
  SiRNA target sequence
aagtgacaataatattttt

SEQ ID NO: 241162 - DNA, 19 bp, Artificial sequence
  SiRNA target sequence
agtgacaataatattttta

SEQ ID NO: 241163 - DNA, 19 bp, Artificial sequence
  SiRNA target sequence
gtgacaataatatttttac

SEQ ID NO: 241164 - DNA, 19 bp, Artificial sequence
  SiRNA target sequence
tgacaataatatttttact

SEQ ID NO: 241165 - DNA, 19 bp, Artificial sequence
  SiRNA target sequence
gacaataatatttttactt

SEQ ID NO: 241166 - DNA, 19 bp, Artificial sequence
  SiRNA target sequence
acaataatatttttacttt

SEQ ID NO: 241167 - DNA, 19 bp, Artificial sequence
  SiRNA target sequence
caataatatttttactttt

SEQ ID NO: 241168 - DNA, 19 bp, Artificial sequence
  SiRNA target sequence
aataatatttttacttttg

SEQ ID NO: 241169 - DNA, 19 bp, Artificial sequence
  SiRNA target sequence
ataatatttttacttttgg

SEQ ID NO: 241170 - DNA, 19 bp, Artificial sequence
  SiRNA target sequence
taatatttttacttttggg

SEQ ID NO: 241171 - DNA, 19 bp, Artificial sequence
  SiRNA target sequence
aatatttttacttttggga

SEQ ID NO: 241172 - DNA, 19 bp, Artificial sequence
  SiRNA target sequence
atatttttacttttgggaa

SEQ ID NO: 241173 - DNA, 19 bp, Artificial sequence
  SiRNA target sequence
tatttttacttttgggaat

SEQ ID NO: 241174 - DNA, 19 bp, Artificial sequence
  SiRNA target sequence
atttttacttttgggaatt

SEQ ID NO: 241175 - DNA, 19 bp, Artificial sequence
  SiRNA target sequence
tttttacttttgggaattt

SEQ ID NO: 241176 - DNA, 19 bp, Artificial sequence
  SiRNA target sequence
ttttacttttgggaatttt

SEQ ID NO: 241177 - DNA, 19 bp, Artificial sequence
  SiRNA target sequence
tttacttttgggaattttt

SEQ ID NO: 241178 - DNA, 19 bp, Artificial sequence
  SiRNA target sequence
ttacttttgggaatttttt

SEQ ID NO: 241179 - DNA, 19 bp, Artificial sequence
  SiRNA target sequence
tacttttgggaattttttt

SEQ ID NO: 241180 - DNA, 19 bp, Artificial sequence
  SiRNA target sequence
acttttgggaatttttttg

SEQ ID NO: 241181 - DNA, 19 bp, Artificial sequence
  SiRNA target sequence
cttttgggaatttttttgt

SEQ ID NO: 241182 - DNA, 19 bp, Artificial sequence
  SiRNA target sequence
ttttgggaatttttttgtc

SEQ ID NO: 241183 - DNA, 19 bp, Artificial sequence
  SiRNA target sequence
tttgggaatttttttgtct

SEQ ID NO: 241184 - DNA, 19 bp, Artificial sequence
  SiRNA target sequence
ttgggaatttttttgtctt

SEQ ID NO: 241185 - DNA, 19 bp, Artificial sequence
  SiRNA target sequence
tgggaatttttttgtctta

SEQ ID NO: 241186 - DNA, 19 bp, Artificial sequence
  SiRNA target sequence
gggaatttttttgtcttag

SEQ ID NO: 241187 - DNA, 19 bp, Artificial sequence
  SiRNA target sequence
ggaatttttttgtcttagt

SEQ ID NO: 241188 - DNA, 19 bp, Artificial sequence
  SiRNA target sequence
gaatttttttgtcttagtc

SEQ ID NO: 241189 - DNA, 19 bp, Artificial sequence
  SiRNA target sequence
aatttttttgtcttagtca

SEQ ID NO: 241190 - DNA, 19 bp, Artificial sequence
  SiRNA target sequence
atttttttgtcttagtcat

SEQ ID NO: 241191 - DNA, 20 bp, Artificial sequence
  SiRNA target sequence
ttaattaaaatcaacatcta

SEQ ID NO: 241192 - DNA, 20 bp, Artificial sequence
  SiRNA target sequence
taattaaaatcaacatctat

SEQ ID NO: 241193 - DNA, 20 bp, Artificial sequence
  SiRNA target sequence
aattaaaatcaacatctatc

SEQ ID NO: 241194 - DNA, 20 bp, Artificial sequence
  SiRNA target sequence
attaaaatcaacatctatct

SEQ ID NO: 241195 - DNA, 20 bp, Artificial sequence
  SiRNA target sequence
ttaaaatcaacatctatctc

SEQ ID NO: 241196 - DNA, 20 bp, Artificial sequence
  SiRNA target sequence
taaaatcaacatctatctca

SEQ ID NO: 241197 - DNA, 20 bp, Artificial sequence
  SiRNA target sequence
aaaatcaacatctatctcag

SEQ ID NO: 241198 - DNA, 20 bp, Artificial sequence
  SiRNA target sequence
aaatcaacatctatctcaga

SEQ ID NO: 241199 - DNA, 20 bp, Artificial sequence
  SiRNA target sequence
aatcaacatctatctcagaa

SEQ ID NO: 241200 - DNA, 20 bp, Artificial sequence
  SiRNA target sequence
atcaacatctatctcagaat

SEQ ID NO: 241201 - DNA, 20 bp, Artificial sequence
  SiRNA target sequence
tcaacatctatctcagaatt

SEQ ID NO: 241202 - DNA, 20 bp, Artificial sequence
  SiRNA target sequence
caacatctatctcagaattt

SEQ ID NO: 241203 - DNA, 20 bp, Artificial sequence
  SiRNA target sequence
aacatctatctcagaatttt

SEQ ID NO: 241204 - DNA, 20 bp, Artificial sequence
  SiRNA target sequence
acatctatctcagaattttg

SEQ ID NO: 241205 - DNA, 20 bp, Artificial sequence
  SiRNA target sequence
catctatctcagaattttgt

SEQ ID NO: 241206 - DNA, 20 bp, Artificial sequence
  SiRNA target sequence
atctatctcagaattttgtt

SEQ ID NO: 241207 - DNA, 20 bp, Artificial sequence
  SiRNA target sequence
tctatctcagaattttgttc

SEQ ID NO: 241208 - DNA, 20 bp, Artificial sequence
  SiRNA target sequence
ctatctcagaattttgttca

SEQ ID NO: 241209 - DNA, 20 bp, Artificial sequence
  SiRNA target sequence
tatctcagaattttgttcaa

SEQ ID NO: 241210 - DNA, 20 bp, Artificial sequence
  SiRNA target sequence
atctcagaattttgttcaat

SEQ ID NO: 241211 - DNA, 20 bp, Artificial sequence
  SiRNA target sequence
tctcagaattttgttcaatt

SEQ ID NO: 241212 - DNA, 20 bp, Artificial sequence
  SiRNA target sequence
ctcagaattttgttcaattg

SEQ ID NO: 241213 - DNA, 20 bp, Artificial sequence
  SiRNA target sequence
tcagaattttgttcaattga

SEQ ID NO: 241214 - DNA, 20 bp, Artificial sequence
  SiRNA target sequence
cagaattttgttcaattgat

SEQ ID NO: 241215 - DNA, 20 bp, Artificial sequence
  SiRNA target sequence
agaattttgttcaattgatt

SEQ ID NO: 241216 - DNA, 20 bp, Artificial sequence
  SiRNA target sequence
gaattttgttcaattgattc

SEQ ID NO: 241217 - DNA, 20 bp, Artificial sequence
  SiRNA target sequence
aattttgttcaattgattca

SEQ ID NO: 241218 - DNA, 20 bp, Artificial sequence
  SiRNA target sequence
attttgttcaattgattcat

SEQ ID NO: 241219 - DNA, 20 bp, Artificial sequence
  SiRNA target sequence
ttttgttcaattgattcatt

SEQ ID NO: 241220 - DNA, 20 bp, Artificial sequence
  SiRNA target sequence
tttgttcaattgattcatta

SEQ ID NO: 241221 - DNA, 20 bp, Artificial sequence
  SiRNA target sequence
ttgttcaattgattcattat

SEQ ID NO: 241222 - DNA, 20 bp, Artificial sequence
  SiRNA target sequence
tgttcaattgattcattata

SEQ ID NO: 241223 - DNA, 20 bp, Artificial sequence
  SiRNA target sequence
gttcaattgattcattatat

SEQ ID NO: 241224 - DNA, 20 bp, Artificial sequence
  SiRNA target sequence
ttcaattgattcattatatt

SEQ ID NO: 241225 - DNA, 20 bp, Artificial sequence
  SiRNA target sequence
tcaattgattcattatattt

SEQ ID NO: 241226 - DNA, 20 bp, Artificial sequence
  SiRNA target sequence
caattgattcattatatttt

SEQ ID NO: 241227 - DNA, 20 bp, Artificial sequence
  SiRNA target sequence
aattgattcattatattttt

SEQ ID NO: 241228 - DNA, 20 bp, Artificial sequence
  SiRNA target sequence
attgattcattatatttttt

SEQ ID NO: 241229 - DNA, 20 bp, Artificial sequence
  SiRNA target sequence
ttgattcattatatttttta

SEQ ID NO: 241230 - DNA, 20 bp, Artificial sequence
  SiRNA target sequence
tgattcattatattttttac

SEQ ID NO: 241231 - DNA, 20 bp, Artificial sequence
  SiRNA target sequence
gattcattatattttttact

SEQ ID NO: 241232 - DNA, 20 bp, Artificial sequence
  SiRNA target sequence
attcattatattttttactt

SEQ ID NO: 241233 - DNA, 20 bp, Artificial sequence
  SiRNA target sequence
ttcattatattttttactta

SEQ ID NO: 241234 - DNA, 20 bp, Artificial sequence
  SiRNA target sequence
tcattatattttttacttaa

SEQ ID NO: 241235 - DNA, 20 bp, Artificial sequence
  SiRNA target sequence
cattatattttttacttaaa

SEQ ID NO: 241236 - DNA, 20 bp, Artificial sequence
  SiRNA target sequence
attatattttttacttaaat

SEQ ID NO: 241237 - DNA, 20 bp, Artificial sequence
  SiRNA target sequence
ttatattttttacttaaata

SEQ ID NO: 241238 - DNA, 20 bp, Artificial sequence
  SiRNA target sequence
tatattttttacttaaataa

SEQ ID NO: 241239 - DNA, 20 bp, Artificial sequence
  SiRNA target sequence
atattttttacttaaataac

SEQ ID NO: 241240 - DNA, 20 bp, Artificial sequence
  SiRNA target sequence
tattttttacttaaataaca

SEQ ID NO: 241241 - DNA, 20 bp, Artificial sequence
  SiRNA target sequence
attttttacttaaataacag

SEQ ID NO: 241242 - DNA, 20 bp, Artificial sequence
  SiRNA target sequence
ttttttacttaaataacaga

SEQ ID NO: 241243 - DNA, 20 bp, Artificial sequence
  SiRNA target sequence
tttttacttaaataacagac

SEQ ID NO: 241244 - DNA, 20 bp, Artificial sequence
  SiRNA target sequence
ttttacttaaataacagaca

SEQ ID NO: 241245 - DNA, 20 bp, Artificial sequence
  SiRNA target sequence
tttacttaaataacagacac

SEQ ID NO: 241246 - DNA, 20 bp, Artificial sequence
  SiRNA target sequence
ttacttaaataacagacact

SEQ ID NO: 241247 - DNA, 20 bp, Artificial sequence
  SiRNA target sequence
tacttaaataacagacactc

SEQ ID NO: 241248 - DNA, 20 bp, Artificial sequence
  SiRNA target sequence
acttaaataacagacactcc

SEQ ID NO: 241249 - DNA, 20 bp, Artificial sequence
  SiRNA target sequence
cttaaataacagacactcct

SEQ ID NO: 241250 - DNA, 20 bp, Artificial sequence
  SiRNA target sequence
ttaaataacagacactcctg

SEQ ID NO: 241251 - DNA, 20 bp, Artificial sequence
  SiRNA target sequence
taaataacagacactcctga

SEQ ID NO: 241252 - DNA, 20 bp, Artificial sequence
  SiRNA target sequence
aaataacagacactcctgat

SEQ ID NO: 241253 - DNA, 20 bp, Artificial sequence
  SiRNA target sequence
aataacagacactcctgatc

SEQ ID NO: 241254 - DNA, 20 bp, Artificial sequence
  SiRNA target sequence
ataacagacactcctgatcc

SEQ ID NO: 241255 - DNA, 20 bp, Artificial sequence
  SiRNA target sequence
taacagacactcctgatcca

SEQ ID NO: 241256 - DNA, 20 bp, Artificial sequence
  SiRNA target sequence
aacagacactcctgatccac

SEQ ID NO: 241257 - DNA, 20 bp, Artificial sequence
  SiRNA target sequence
acagacactcctgatccaca

SEQ ID NO: 241258 - DNA, 20 bp, Artificial sequence
  SiRNA target sequence
cagacactcctgatccacaa

SEQ ID NO: 241259 - DNA, 20 bp, Artificial sequence
  SiRNA target sequence
agacactcctgatccacaaa

SEQ ID NO: 241260 - DNA, 20 bp, Artificial sequence
  SiRNA target sequence
gacactcctgatccacaaaa

SEQ ID NO: 241261 - DNA, 20 bp, Artificial sequence
  SiRNA target sequence
acactcctgatccacaaaaa

SEQ ID NO: 241262 - DNA, 20 bp, Artificial sequence
  SiRNA target sequence
cactcctgatccacaaaaaa

SEQ ID NO: 241263 - DNA, 20 bp, Artificial sequence
  SiRNA target sequence
actcctgatccacaaaaaat

SEQ ID NO: 241264 - DNA, 20 bp, Artificial sequence
  SiRNA target sequence
ctcctgatccacaaaaaatt

SEQ ID NO: 241265 - DNA, 20 bp, Artificial sequence
  SiRNA target sequence
tcctgatccacaaaaaattt

SEQ ID NO: 241266 - DNA, 20 bp, Artificial sequence
  SiRNA target sequence
cctgatccacaaaaaatttg

SEQ ID NO: 241267 - DNA, 20 bp, Artificial sequence
  SiRNA target sequence
ctgatccacaaaaaatttgc

SEQ ID NO: 241268 - DNA, 20 bp, Artificial sequence
  SiRNA target sequence
tgatccacaaaaaatttgca

SEQ ID NO: 241269 - DNA, 20 bp, Artificial sequence
  SiRNA target sequence
gatccacaaaaaatttgcaa

SEQ ID NO: 241270 - DNA, 20 bp, Artificial sequence
  SiRNA target sequence
atccacaaaaaatttgcaaa

SEQ ID NO: 241271 - DNA, 20 bp, Artificial sequence
  SiRNA target sequence
tccacaaaaaatttgcaaat

SEQ ID NO: 241272 - DNA, 20 bp, Artificial sequence
  SiRNA target sequence
ccacaaaaaatttgcaaata

SEQ ID NO: 241273 - DNA, 20 bp, Artificial sequence
  SiRNA target sequence
cacaaaaaatttgcaaatat

SEQ ID NO: 241274 - DNA, 20 bp, Artificial sequence
  SiRNA target sequence
acaaaaaatttgcaaatatt

SEQ ID NO: 241275 - DNA, 20 bp, Artificial sequence
  SiRNA target sequence
caaaaaatttgcaaatatta

SEQ ID NO: 241276 - DNA, 20 bp, Artificial sequence
  SiRNA target sequence
aaaaaatttgcaaatattaa

SEQ ID NO: 241277 - DNA, 20 bp, Artificial sequence
  SiRNA target sequence
aaaaatttgcaaatattaaa

SEQ ID NO: 241278 - DNA, 20 bp, Artificial sequence
  SiRNA target sequence
aaaatttgcaaatattaaaa

SEQ ID NO: 241279 - DNA, 20 bp, Artificial sequence
  SiRNA target sequence
aaatttgcaaatattaaaaa

SEQ ID NO: 241280 - DNA, 20 bp, Artificial sequence
  SiRNA target sequence
aatttgcaaatattaaaaat

SEQ ID NO: 241281 - DNA, 20 bp, Artificial sequence
  SiRNA target sequence
atttgcaaatattaaaaata

SEQ ID NO: 241282 - DNA, 20 bp, Artificial sequence
  SiRNA target sequence
tttgcaaatattaaaaatat

SEQ ID NO: 241283 - DNA, 20 bp, Artificial sequence
  SiRNA target sequence
ttgcaaatattaaaaatata

SEQ ID NO: 241284 - DNA, 20 bp, Artificial sequence
  SiRNA target sequence
tgcaaatattaaaaatataa

SEQ ID NO: 241285 - DNA, 20 bp, Artificial sequence
  SiRNA target sequence
gcaaatattaaaaatataaa

SEQ ID NO: 241286 - DNA, 20 bp, Artificial sequence
  SiRNA target sequence
caaatattaaaaatataaaa

SEQ ID NO: 241287 - DNA, 20 bp, Artificial sequence
  SiRNA target sequence
aaatattaaaaatataaaag

SEQ ID NO: 241288 - DNA, 20 bp, Artificial sequence
  SiRNA target sequence
aatattaaaaatataaaaga

SEQ ID NO: 241289 - DNA, 20 bp, Artificial sequence
  SiRNA target sequence
atattaaaaatataaaagac

SEQ ID NO: 241290 - DNA, 20 bp, Artificial sequence
  SiRNA target sequence
tattaaaaatataaaagaca

SEQ ID NO: 241291 - DNA, 20 bp, Artificial sequence
  SiRNA target sequence
attaaaaatataaaagacac

SEQ ID NO: 241292 - DNA, 20 bp, Artificial sequence
  SiRNA target sequence
ttaaaaatataaaagacacg

SEQ ID NO: 241293 - DNA, 20 bp, Artificial sequence
  SiRNA target sequence
taaaaatataaaagacacgt

SEQ ID NO: 241294 - DNA, 20 bp, Artificial sequence
  SiRNA target sequence
aaaaatataaaagacacgta

SEQ ID NO: 241295 - DNA, 20 bp, Artificial sequence
  SiRNA target sequence
aaaatataaaagacacgtat

SEQ ID NO: 241296 - DNA, 20 bp, Artificial sequence
  SiRNA target sequence
aaatataaaagacacgtatg

SEQ ID NO: 241297 - DNA, 20 bp, Artificial sequence
  SiRNA target sequence
aatataaaagacacgtatga

SEQ ID NO: 241298 - DNA, 20 bp, Artificial sequence
  SiRNA target sequence
atataaaagacacgtatgat

SEQ ID NO: 241299 - DNA, 20 bp, Artificial sequence
  SiRNA target sequence
tataaaagacacgtatgata

SEQ ID NO: 241300 - DNA, 20 bp, Artificial sequence
  SiRNA target sequence
ataaaagacacgtatgatac

SEQ ID NO: 241301 - DNA, 20 bp, Artificial sequence
  SiRNA target sequence
taaaagacacgtatgatact

SEQ ID NO: 241302 - DNA, 20 bp, Artificial sequence
  SiRNA target sequence
aaaagacacgtatgatactt

SEQ ID NO: 241303 - DNA, 20 bp, Artificial sequence
  SiRNA target sequence
aaagacacgtatgatacttg

SEQ ID NO: 241304 - DNA, 20 bp, Artificial sequence
  SiRNA target sequence
aagacacgtatgatacttgt

SEQ ID NO: 241305 - DNA, 20 bp, Artificial sequence
  SiRNA target sequence
agacacgtatgatacttgtc

SEQ ID NO: 241306 - DNA, 20 bp, Artificial sequence
  SiRNA target sequence
gacacgtatgatacttgtct

SEQ ID NO: 241307 - DNA, 20 bp, Artificial sequence
  SiRNA target sequence
acacgtatgatacttgtcta

SEQ ID NO: 241308 - DNA, 20 bp, Artificial sequence
  SiRNA target sequence
cacgtatgatacttgtctaa

SEQ ID NO: 241309 - DNA, 20 bp, Artificial sequence
  SiRNA target sequence
acgtatgatacttgtctaat

SEQ ID NO: 241310 - DNA, 20 bp, Artificial sequence
  SiRNA target sequence
cgtatgatacttgtctaata

SEQ ID NO: 241311 - DNA, 20 bp, Artificial sequence
  SiRNA target sequence
gtatgatacttgtctaatat

SEQ ID NO: 241312 - DNA, 20 bp, Artificial sequence
  SiRNA target sequence
tatgatacttgtctaatatc

SEQ ID NO: 241313 - DNA, 20 bp, Artificial sequence
  SiRNA target sequence
atgatacttgtctaatatct

SEQ ID NO: 241314 - DNA, 20 bp, Artificial sequence
  SiRNA target sequence
tgatacttgtctaatatctg

SEQ ID NO: 241315 - DNA, 20 bp, Artificial sequence
  SiRNA target sequence
gatacttgtctaatatctgg

SEQ ID NO: 241316 - DNA, 20 bp, Artificial sequence
  SiRNA target sequence
atacttgtctaatatctgga

SEQ ID NO: 241317 - DNA, 20 bp, Artificial sequence
  SiRNA target sequence
tacttgtctaatatctggaa

SEQ ID NO: 241318 - DNA, 20 bp, Artificial sequence
  SiRNA target sequence
acttgtctaatatctggaat

SEQ ID NO: 241319 - DNA, 20 bp, Artificial sequence
  SiRNA target sequence
cttgtctaatatctggaatt

SEQ ID NO: 241320 - DNA, 20 bp, Artificial sequence
  SiRNA target sequence
ttgtctaatatctggaattt

SEQ ID NO: 241321 - DNA, 20 bp, Artificial sequence
  SiRNA target sequence
tgtctaatatctggaatttc

SEQ ID NO: 241322 - DNA, 20 bp, Artificial sequence
  SiRNA target sequence
gtctaatatctggaatttct

SEQ ID NO: 241323 - DNA, 20 bp, Artificial sequence
  SiRNA target sequence
tctaatatctggaatttcta

SEQ ID NO: 241324 - DNA, 20 bp, Artificial sequence
  SiRNA target sequence
ctaatatctggaatttctat

SEQ ID NO: 241325 - DNA, 20 bp, Artificial sequence
  SiRNA target sequence
taatatctggaatttctata

SEQ ID NO: 241326 - DNA, 20 bp, Artificial sequence
  SiRNA target sequence
aatatctggaatttctataa

SEQ ID NO: 241327 - DNA, 20 bp, Artificial sequence
  SiRNA target sequence
atatctggaatttctataaa

SEQ ID NO: 241328 - DNA, 20 bp, Artificial sequence
  SiRNA target sequence
tatctggaatttctataaac

SEQ ID NO: 241329 - DNA, 20 bp, Artificial sequence
  SiRNA target sequence
atctggaatttctataaacg

SEQ ID NO: 241330 - DNA, 20 bp, Artificial sequence
  SiRNA target sequence
tctggaatttctataaacgt

SEQ ID NO: 241331 - DNA, 20 bp, Artificial sequence
  SiRNA target sequence
ctggaatttctataaacgtc

SEQ ID NO: 241332 - DNA, 20 bp, Artificial sequence
  SiRNA target sequence
tggaatttctataaacgtca

SEQ ID NO: 241333 - DNA, 20 bp, Artificial sequence
  SiRNA target sequence
ggaatttctataaacgtcaa

SEQ ID NO: 241334 - DNA, 20 bp, Artificial sequence
  SiRNA target sequence
gaatttctataaacgtcaaa

SEQ ID NO: 241335 - DNA, 20 bp, Artificial sequence
  SiRNA target sequence
aatttctataaacgtcaaaa

SEQ ID NO: 241336 - DNA, 20 bp, Artificial sequence
  SiRNA target sequence
atttctataaacgtcaaaaa

SEQ ID NO: 241337 - DNA, 20 bp, Artificial sequence
  SiRNA target sequence
tttctataaacgtcaaaaaa

SEQ ID NO: 241338 - DNA, 20 bp, Artificial sequence
  SiRNA target sequence
ttctataaacgtcaaaaaag

SEQ ID NO: 241339 - DNA, 20 bp, Artificial sequence
  SiRNA target sequence
tctataaacgtcaaaaaagt

SEQ ID NO: 241340 - DNA, 20 bp, Artificial sequence
  SiRNA target sequence
ctataaacgtcaaaaaagtt

SEQ ID NO: 241341 - DNA, 20 bp, Artificial sequence
  SiRNA target sequence
tataaacgtcaaaaaagttc

SEQ ID NO: 241342 - DNA, 20 bp, Artificial sequence
  SiRNA target sequence
ataaacgtcaaaaaagttcc

SEQ ID NO: 241343 - DNA, 20 bp, Artificial sequence
  SiRNA target sequence
taaacgtcaaaaaagttcca

SEQ ID NO: 241344 - DNA, 20 bp, Artificial sequence
  SiRNA target sequence
aaacgtcaaaaaagttccat

SEQ ID NO: 241345 - DNA, 20 bp, Artificial sequence
  SiRNA target sequence
aacgtcaaaaaagttccata

SEQ ID NO: 241346 - DNA, 20 bp, Artificial sequence
  SiRNA target sequence
acgtcaaaaaagttccatat

SEQ ID NO: 241347 - DNA, 20 bp, Artificial sequence
  SiRNA target sequence
cgtcaaaaaagttccatata

SEQ ID NO: 241348 - DNA, 20 bp, Artificial sequence
  SiRNA target sequence
gtcaaaaaagttccatataa

SEQ ID NO: 241349 - DNA, 20 bp, Artificial sequence
  SiRNA target sequence
tcaaaaaagttccatataaa

SEQ ID NO: 241350 - DNA, 20 bp, Artificial sequence
  SiRNA target sequence
caaaaaagttccatataaag

SEQ ID NO: 241351 - DNA, 20 bp, Artificial sequence
  SiRNA target sequence
aaaaaagttccatataaaga

SEQ ID NO: 241352 - DNA, 20 bp, Artificial sequence
  SiRNA target sequence
aaaaagttccatataaagag

SEQ ID NO: 241353 - DNA, 20 bp, Artificial sequence
  SiRNA target sequence
aaaagttccatataaagaga

SEQ ID NO: 241354 - DNA, 20 bp, Artificial sequence
  SiRNA target sequence
aaagttccatataaagagat

SEQ ID NO: 241355 - DNA, 20 bp, Artificial sequence
  SiRNA target sequence
aagttccatataaagagata

SEQ ID NO: 241356 - DNA, 20 bp, Artificial sequence
  SiRNA target sequence
agttccatataaagagataa

SEQ ID NO: 241357 - DNA, 20 bp, Artificial sequence
  SiRNA target sequence
gttccatataaagagataat

SEQ ID NO: 241358 - DNA, 20 bp, Artificial sequence
  SiRNA target sequence
ttccatataaagagataata

SEQ ID NO: 241359 - DNA, 20 bp, Artificial sequence
  SiRNA target sequence
tccatataaagagataatag

SEQ ID NO: 241360 - DNA, 20 bp, Artificial sequence
  SiRNA target sequence
ccatataaagagataataga

SEQ ID NO: 241361 - DNA, 20 bp, Artificial sequence
  SiRNA target sequence
catataaagagataatagat

SEQ ID NO: 241362 - DNA, 20 bp, Artificial sequence
  SiRNA target sequence
atataaagagataatagatt

SEQ ID NO: 241363 - DNA, 20 bp, Artificial sequence
  SiRNA target sequence
tataaagagataatagattt

SEQ ID NO: 241364 - DNA, 20 bp, Artificial sequence
  SiRNA target sequence
ataaagagataatagattta

SEQ ID NO: 241365 - DNA, 20 bp, Artificial sequence
  SiRNA target sequence
taaagagataatagatttac

SEQ ID NO: 241366 - DNA, 20 bp, Artificial sequence
  SiRNA target sequence
aaagagataatagatttacc

SEQ ID NO: 241367 - DNA, 20 bp, Artificial sequence
  SiRNA target sequence
aagagataatagatttacca

SEQ ID NO: 241368 - DNA, 20 bp, Artificial sequence
  SiRNA target sequence
agagataatagatttaccaa

SEQ ID NO: 241369 - DNA, 20 bp, Artificial sequence
  SiRNA target sequence
gagataatagatttaccaat

SEQ ID NO: 241370 - DNA, 20 bp, Artificial sequence
  SiRNA target sequence
agataatagatttaccaatt

SEQ ID NO: 241371 - DNA, 20 bp, Artificial sequence
  SiRNA target sequence
gataatagatttaccaattt

SEQ ID NO: 241372 - DNA, 20 bp, Artificial sequence
  SiRNA target sequence
ataatagatttaccaatttt

SEQ ID NO: 241373 - DNA, 20 bp, Artificial sequence
  SiRNA target sequence
taatagatttaccaattttg

SEQ ID NO: 241374 - DNA, 20 bp, Artificial sequence
  SiRNA target sequence
aatagatttaccaattttga

SEQ ID NO: 241375 - DNA, 20 bp, Artificial sequence
  SiRNA target sequence
atagatttaccaattttgat

SEQ ID NO: 241376 - DNA, 20 bp, Artificial sequence
  SiRNA target sequence
tagatttaccaattttgata

SEQ ID NO: 241377 - DNA, 20 bp, Artificial sequence
  SiRNA target sequence
agatttaccaattttgatac

SEQ ID NO: 241378 - DNA, 20 bp, Artificial sequence
  SiRNA target sequence
gatttaccaattttgataca

SEQ ID NO: 241379 - DNA, 20 bp, Artificial sequence
  SiRNA target sequence
atttaccaattttgatacat

SEQ ID NO: 241380 - DNA, 20 bp, Artificial sequence
  SiRNA target sequence
tttaccaattttgatacata

SEQ ID NO: 241381 - DNA, 20 bp, Artificial sequence
  SiRNA target sequence
ttaccaattttgatacatac

SEQ ID NO: 241382 - DNA, 20 bp, Artificial sequence
  SiRNA target sequence
taccaattttgatacataca

SEQ ID NO: 241383 - DNA, 20 bp, Artificial sequence
  SiRNA target sequence
accaattttgatacatacac

SEQ ID NO: 241384 - DNA, 20 bp, Artificial sequence
  SiRNA target sequence
ccaattttgatacatacacc

SEQ ID NO: 241385 - DNA, 20 bp, Artificial sequence
  SiRNA target sequence
caattttgatacatacacca

SEQ ID NO: 241386 - DNA, 20 bp, Artificial sequence
  SiRNA target sequence
aattttgatacatacaccat

SEQ ID NO: 241387 - DNA, 20 bp, Artificial sequence
  SiRNA target sequence
attttgatacatacaccatc

SEQ ID NO: 241388 - DNA, 20 bp, Artificial sequence
  SiRNA target sequence
ttttgatacatacaccatca

SEQ ID NO: 241389 - DNA, 20 bp, Artificial sequence
  SiRNA target sequence
tttgatacatacaccatcat

SEQ ID NO: 241390 - DNA, 20 bp, Artificial sequence
  SiRNA target sequence
ttgatacatacaccatcata

SEQ ID NO: 241391 - DNA, 20 bp, Artificial sequence
  SiRNA target sequence
tgatacatacaccatcataa

SEQ ID NO: 241392 - DNA, 20 bp, Artificial sequence
  SiRNA target sequence
gatacatacaccatcataaa

SEQ ID NO: 241393 - DNA, 20 bp, Artificial sequence
  SiRNA target sequence
atacatacaccatcataaaa

SEQ ID NO: 241394 - DNA, 20 bp, Artificial sequence
  SiRNA target sequence
tacatacaccatcataaaaa

SEQ ID NO: 241395 - DNA, 20 bp, Artificial sequence
  SiRNA target sequence
acatacaccatcataaaaac

SEQ ID NO: 241396 - DNA, 20 bp, Artificial sequence
  SiRNA target sequence
catacaccatcataaaaact

SEQ ID NO: 241397 - DNA, 20 bp, Artificial sequence
  SiRNA target sequence
atacaccatcataaaaactt

SEQ ID NO: 241398 - DNA, 20 bp, Artificial sequence
  SiRNA target sequence
tacaccatcataaaaacttt

SEQ ID NO: 241399 - DNA, 20 bp, Artificial sequence
  SiRNA target sequence
acaccatcataaaaactttt

SEQ ID NO: 241400 - DNA, 20 bp, Artificial sequence
  SiRNA target sequence
caccatcataaaaactttta

SEQ ID NO: 241401 - DNA, 20 bp, Artificial sequence
  SiRNA target sequence
accatcataaaaacttttaa

SEQ ID NO: 241402 - DNA, 20 bp, Artificial sequence
  SiRNA target sequence
ccatcataaaaacttttaaa

SEQ ID NO: 241403 - DNA, 20 bp, Artificial sequence
  SiRNA target sequence
catcataaaaacttttaaat

SEQ ID NO: 241404 - DNA, 20 bp, Artificial sequence
  SiRNA target sequence
atcataaaaacttttaaatt

SEQ ID NO: 241405 - DNA, 20 bp, Artificial sequence
  SiRNA target sequence
tcataaaaacttttaaattt

SEQ ID NO: 241406 - DNA, 20 bp, Artificial sequence
  SiRNA target sequence
cataaaaacttttaaattta

SEQ ID NO: 241407 - DNA, 20 bp, Artificial sequence
  SiRNA target sequence
ataaaaacttttaaatttat

SEQ ID NO: 241408 - DNA, 20 bp, Artificial sequence
  SiRNA target sequence
taaaaacttttaaatttata

SEQ ID NO: 241409 - DNA, 20 bp, Artificial sequence
  SiRNA target sequence
aaaaacttttaaatttatac

SEQ ID NO: 241410 - DNA, 20 bp, Artificial sequence
  SiRNA target sequence
aaaacttttaaatttatacc

SEQ ID NO: 241411 - DNA, 20 bp, Artificial sequence
  SiRNA target sequence
aaacttttaaatttatacct

SEQ ID NO: 241412 - DNA, 20 bp, Artificial sequence
  SiRNA target sequence
aacttttaaatttatacctg

SEQ ID NO: 241413 - DNA, 20 bp, Artificial sequence
  SiRNA target sequence
acttttaaatttatacctgt

SEQ ID NO: 241414 - DNA, 20 bp, Artificial sequence
  SiRNA target sequence
cttttaaatttatacctgta

SEQ ID NO: 241415 - DNA, 20 bp, Artificial sequence
  SiRNA target sequence
ttttaaatttatacctgtat

SEQ ID NO: 241416 - DNA, 20 bp, Artificial sequence
  SiRNA target sequence
tttaaatttatacctgtatt

SEQ ID NO: 241417 - DNA, 20 bp, Artificial sequence
  SiRNA target sequence
ttaaatttatacctgtattt

SEQ ID NO: 241418 - DNA, 20 bp, Artificial sequence
  SiRNA target sequence
taaatttatacctgtattta

SEQ ID NO: 241419 - DNA, 20 bp, Artificial sequence
  SiRNA target sequence
aaatttatacctgtatttaa

SEQ ID NO: 241420 - DNA, 20 bp, Artificial sequence
  SiRNA target sequence
aatttatacctgtatttaac

SEQ ID NO: 241421 - DNA, 20 bp, Artificial sequence
  SiRNA target sequence
atttatacctgtatttaaca

SEQ ID NO: 241422 - DNA, 20 bp, Artificial sequence
  SiRNA target sequence
tttatacctgtatttaacag

SEQ ID NO: 241423 - DNA, 20 bp, Artificial sequence
  SiRNA target sequence
ttatacctgtatttaacagg

SEQ ID NO: 241424 - DNA, 20 bp, Artificial sequence
  SiRNA target sequence
tatacctgtatttaacaggc

SEQ ID NO: 241425 - DNA, 20 bp, Artificial sequence
  SiRNA target sequence
atacctgtatttaacaggca

SEQ ID NO: 241426 - DNA, 20 bp, Artificial sequence
  SiRNA target sequence
tacctgtatttaacaggcac

SEQ ID NO: 241427 - DNA, 20 bp, Artificial sequence
  SiRNA target sequence
acctgtatttaacaggcacc

SEQ ID NO: 241428 - DNA, 20 bp, Artificial sequence
  SiRNA target sequence
cctgtatttaacaggcaccc

SEQ ID NO: 241429 - DNA, 20 bp, Artificial sequence
  SiRNA target sequence
ctgtatttaacaggcaccct

SEQ ID NO: 241430 - DNA, 20 bp, Artificial sequence
  SiRNA target sequence
tgtatttaacaggcaccctc

SEQ ID NO: 241431 - DNA, 20 bp, Artificial sequence
  SiRNA target sequence
gtatttaacaggcaccctca

SEQ ID NO: 241432 - DNA, 20 bp, Artificial sequence
  SiRNA target sequence
tatttaacaggcaccctcat

SEQ ID NO: 241433 - DNA, 20 bp, Artificial sequence
  SiRNA target sequence
atttaacaggcaccctcata

SEQ ID NO: 241434 - DNA, 20 bp, Artificial sequence
  SiRNA target sequence
tttaacaggcaccctcatag

SEQ ID NO: 241435 - DNA, 20 bp, Artificial sequence
  SiRNA target sequence
ttaacaggcaccctcataga

SEQ ID NO: 241436 - DNA, 20 bp, Artificial sequence
  SiRNA target sequence
taacaggcaccctcatagaa

SEQ ID NO: 241437 - DNA, 20 bp, Artificial sequence
  SiRNA target sequence
aacaggcaccctcatagaaa

SEQ ID NO: 241438 - DNA, 20 bp, Artificial sequence
  SiRNA target sequence
acaggcaccctcatagaaag

SEQ ID NO: 241439 - DNA, 20 bp, Artificial sequence
  SiRNA target sequence
caggcaccctcatagaaagc

SEQ ID NO: 241440 - DNA, 20 bp, Artificial sequence
  SiRNA target sequence
aggcaccctcatagaaagca

SEQ ID NO: 241441 - DNA, 20 bp, Artificial sequence
  SiRNA target sequence
ggcaccctcatagaaagcat

SEQ ID NO: 241442 - DNA, 20 bp, Artificial sequence
  SiRNA target sequence
gcaccctcatagaaagcatt

SEQ ID NO: 241443 - DNA, 20 bp, Artificial sequence
  SiRNA target sequence
caccctcatagaaagcattt

SEQ ID NO: 241444 - DNA, 20 bp, Artificial sequence
  SiRNA target sequence
accctcatagaaagcatttc

SEQ ID NO: 241445 - DNA, 20 bp, Artificial sequence
  SiRNA target sequence
ccctcatagaaagcatttct

SEQ ID NO: 241446 - DNA, 20 bp, Artificial sequence
  SiRNA target sequence
cctcatagaaagcatttctt

SEQ ID NO: 241447 - DNA, 20 bp, Artificial sequence
  SiRNA target sequence
ctcatagaaagcatttcttt

SEQ ID NO: 241448 - DNA, 20 bp, Artificial sequence
  SiRNA target sequence
tcatagaaagcatttctttt

SEQ ID NO: 241449 - DNA, 20 bp, Artificial sequence
  SiRNA target sequence
catagaaagcatttcttttg

SEQ ID NO: 241450 - DNA, 20 bp, Artificial sequence
  SiRNA target sequence
atagaaagcatttcttttgc

SEQ ID NO: 241451 - DNA, 20 bp, Artificial sequence
  SiRNA target sequence
tagaaagcatttcttttgct

SEQ ID NO: 241452 - DNA, 20 bp, Artificial sequence
  SiRNA target sequence
agaaagcatttcttttgcta

SEQ ID NO: 241453 - DNA, 20 bp, Artificial sequence
  SiRNA target sequence
gaaagcatttcttttgctaa

SEQ ID NO: 241454 - DNA, 20 bp, Artificial sequence
  SiRNA target sequence
aaagcatttcttttgctaaa

SEQ ID NO: 241455 - DNA, 20 bp, Artificial sequence
  SiRNA target sequence
aagcatttcttttgctaaat

SEQ ID NO: 241456 - DNA, 20 bp, Artificial sequence
  SiRNA target sequence
agcatttcttttgctaaatc

SEQ ID NO: 241457 - DNA, 20 bp, Artificial sequence
  SiRNA target sequence
gcatttcttttgctaaatca

SEQ ID NO: 241458 - DNA, 20 bp, Artificial sequence
  SiRNA target sequence
catttcttttgctaaatcaa

SEQ ID NO: 241459 - DNA, 20 bp, Artificial sequence
  SiRNA target sequence
atttcttttgctaaatcaaa

SEQ ID NO: 241460 - DNA, 20 bp, Artificial sequence
  SiRNA target sequence
tttcttttgctaaatcaaat

SEQ ID NO: 241461 - DNA, 20 bp, Artificial sequence
  SiRNA target sequence
ttcttttgctaaatcaaata

SEQ ID NO: 241462 - DNA, 20 bp, Artificial sequence
  SiRNA target sequence
tcttttgctaaatcaaataa

SEQ ID NO: 241463 - DNA, 20 bp, Artificial sequence
  SiRNA target sequence
cttttgctaaatcaaataaa

SEQ ID NO: 241464 - DNA, 20 bp, Artificial sequence
  SiRNA target sequence
ttttgctaaatcaaataaaa

SEQ ID NO: 241465 - DNA, 20 bp, Artificial sequence
  SiRNA target sequence
tttgctaaatcaaataaaac

SEQ ID NO: 241466 - DNA, 20 bp, Artificial sequence
  SiRNA target sequence
ttgctaaatcaaataaaaca

SEQ ID NO: 241467 - DNA, 20 bp, Artificial sequence
  SiRNA target sequence
tgctaaatcaaataaaacat

SEQ ID NO: 241468 - DNA, 20 bp, Artificial sequence
  SiRNA target sequence
gctaaatcaaataaaacata

SEQ ID NO: 241469 - DNA, 20 bp, Artificial sequence
  SiRNA target sequence
ctaaatcaaataaaacatat

SEQ ID NO: 241470 - DNA, 20 bp, Artificial sequence
  SiRNA target sequence
taaatcaaataaaacatatt

SEQ ID NO: 241471 - DNA, 20 bp, Artificial sequence
  SiRNA target sequence
aaatcaaataaaacatattt

SEQ ID NO: 241472 - DNA, 20 bp, Artificial sequence
  SiRNA target sequence
aatcaaataaaacatatttg

SEQ ID NO: 241473 - DNA, 20 bp, Artificial sequence
  SiRNA target sequence
atcaaataaaacatatttgg

SEQ ID NO: 241474 - DNA, 20 bp, Artificial sequence
  SiRNA target sequence
tcaaataaaacatatttggt

SEQ ID NO: 241475 - DNA, 20 bp, Artificial sequence
  SiRNA target sequence
caaataaaacatatttggta

SEQ ID NO: 241476 - DNA, 20 bp, Artificial sequence
  SiRNA target sequence
aaataaaacatatttggtaa

SEQ ID NO: 241477 - DNA, 20 bp, Artificial sequence
  SiRNA target sequence
aataaaacatatttggtaat

SEQ ID NO: 241478 - DNA, 20 bp, Artificial sequence
  SiRNA target sequence
ataaaacatatttggtaatt

SEQ ID NO: 241479 - DNA, 20 bp, Artificial sequence
  SiRNA target sequence
taaaacatatttggtaattt

SEQ ID NO: 241480 - DNA, 20 bp, Artificial sequence
  SiRNA target sequence
aaaacatatttggtaatttt

SEQ ID NO: 241481 - DNA, 20 bp, Artificial sequence
  SiRNA target sequence
aaacatatttggtaatttta

SEQ ID NO: 241482 - DNA, 20 bp, Artificial sequence
  SiRNA target sequence
aacatatttggtaattttag

SEQ ID NO: 241483 - DNA, 20 bp, Artificial sequence
  SiRNA target sequence
acatatttggtaattttaga

SEQ ID NO: 241484 - DNA, 20 bp, Artificial sequence
  SiRNA target sequence
catatttggtaattttagaa

SEQ ID NO: 241485 - DNA, 20 bp, Artificial sequence
  SiRNA target sequence
atatttggtaattttagaaa

SEQ ID NO: 241486 - DNA, 20 bp, Artificial sequence
  SiRNA target sequence
tatttggtaattttagaaaa

SEQ ID NO: 241487 - DNA, 20 bp, Artificial sequence
  SiRNA target sequence
atttggtaattttagaaaat

SEQ ID NO: 241488 - DNA, 20 bp, Artificial sequence
  SiRNA target sequence
tttggtaattttagaaaatg

SEQ ID NO: 241489 - DNA, 20 bp, Artificial sequence
  SiRNA target sequence
ttggtaattttagaaaatgc

SEQ ID NO: 241490 - DNA, 20 bp, Artificial sequence
  SiRNA target sequence
tggtaattttagaaaatgca

SEQ ID NO: 241491 - DNA, 20 bp, Artificial sequence
  SiRNA target sequence
ggtaattttagaaaatgcaa

SEQ ID NO: 241492 - DNA, 20 bp, Artificial sequence
  SiRNA target sequence
gtaattttagaaaatgcaaa

SEQ ID NO: 241493 - DNA, 20 bp, Artificial sequence
  SiRNA target sequence
taattttagaaaatgcaaat

SEQ ID NO: 241494 - DNA, 20 bp, Artificial sequence
  SiRNA target sequence
aattttagaaaatgcaaatc

SEQ ID NO: 241495 - DNA, 20 bp, Artificial sequence
  SiRNA target sequence
attttagaaaatgcaaatcc

SEQ ID NO: 241496 - DNA, 20 bp, Artificial sequence
  SiRNA target sequence
ttttagaaaatgcaaatcca

SEQ ID NO: 241497 - DNA, 20 bp, Artificial sequence
  SiRNA target sequence
tttagaaaatgcaaatccaa

SEQ ID NO: 241498 - DNA, 20 bp, Artificial sequence
  SiRNA target sequence
ttagaaaatgcaaatccaat

SEQ ID NO: 241499 - DNA, 20 bp, Artificial sequence
  SiRNA target sequence
tagaaaatgcaaatccaatg

SEQ ID NO: 241500 - DNA, 20 bp, Artificial sequence
  SiRNA target sequence
agaaaatgcaaatccaatgg

SEQ ID NO: 241501 - DNA, 20 bp, Artificial sequence
  SiRNA target sequence
gaaaatgcaaatccaatggt

SEQ ID NO: 241502 - DNA, 20 bp, Artificial sequence
  SiRNA target sequence
aaaatgcaaatccaatggtt

SEQ ID NO: 241503 - DNA, 20 bp, Artificial sequence
  SiRNA target sequence
aaatgcaaatccaatggttg

SEQ ID NO: 241504 - DNA, 20 bp, Artificial sequence
  SiRNA target sequence
aatgcaaatccaatggttgc

SEQ ID NO: 241505 - DNA, 20 bp, Artificial sequence
  SiRNA target sequence
atgcaaatccaatggttgca

SEQ ID NO: 241506 - DNA, 20 bp, Artificial sequence
  SiRNA target sequence
tgcaaatccaatggttgcac

SEQ ID NO: 241507 - DNA, 20 bp, Artificial sequence
  SiRNA target sequence
gcaaatccaatggttgcaca

SEQ ID NO: 241508 - DNA, 20 bp, Artificial sequence
  SiRNA target sequence
caaatccaatggttgcacac

SEQ ID NO: 241509 - DNA, 20 bp, Artificial sequence
  SiRNA target sequence
aaatccaatggttgcacacc

SEQ ID NO: 241510 - DNA, 20 bp, Artificial sequence
  SiRNA target sequence
aatccaatggttgcacacca

SEQ ID NO: 241511 - DNA, 20 bp, Artificial sequence
  SiRNA target sequence
atccaatggttgcacaccaa

SEQ ID NO: 241512 - DNA, 20 bp, Artificial sequence
  SiRNA target sequence
tccaatggttgcacaccaat

SEQ ID NO: 241513 - DNA, 20 bp, Artificial sequence
  SiRNA target sequence
ccaatggttgcacaccaatt

SEQ ID NO: 241514 - DNA, 20 bp, Artificial sequence
  SiRNA target sequence
caatggttgcacaccaattt

SEQ ID NO: 241515 - DNA, 20 bp, Artificial sequence
  SiRNA target sequence
aatggttgcacaccaatttt

SEQ ID NO: 241516 - DNA, 20 bp, Artificial sequence
  SiRNA target sequence
atggttgcacaccaattttc

SEQ ID NO: 241517 - DNA, 20 bp, Artificial sequence
  SiRNA target sequence
tggttgcacaccaattttca

SEQ ID NO: 241518 - DNA, 20 bp, Artificial sequence
  SiRNA target sequence
ggttgcacaccaattttcaa

SEQ ID NO: 241519 - DNA, 20 bp, Artificial sequence
  SiRNA target sequence
gttgcacaccaattttcaag

SEQ ID NO: 241520 - DNA, 20 bp, Artificial sequence
  SiRNA target sequence
ttgcacaccaattttcaaga

SEQ ID NO: 241521 - DNA, 20 bp, Artificial sequence
  SiRNA target sequence
tgcacaccaattttcaagat

SEQ ID NO: 241522 - DNA, 20 bp, Artificial sequence
  SiRNA target sequence
gcacaccaattttcaagatt

SEQ ID NO: 241523 - DNA, 20 bp, Artificial sequence
  SiRNA target sequence
cacaccaattttcaagattt

SEQ ID NO: 241524 - DNA, 20 bp, Artificial sequence
  SiRNA target sequence
acaccaattttcaagattta

SEQ ID NO: 241525 - DNA, 20 bp, Artificial sequence
  SiRNA target sequence
caccaattttcaagatttat

SEQ ID NO: 241526 - DNA, 20 bp, Artificial sequence
  SiRNA target sequence
accaattttcaagatttatt

SEQ ID NO: 241527 - DNA, 20 bp, Artificial sequence
  SiRNA target sequence
ccaattttcaagatttattc

SEQ ID NO: 241528 - DNA, 20 bp, Artificial sequence
  SiRNA target sequence
caattttcaagatttattct

SEQ ID NO: 241529 - DNA, 20 bp, Artificial sequence
  SiRNA target sequence
aattttcaagatttattctt

SEQ ID NO: 241530 - DNA, 20 bp, Artificial sequence
  SiRNA target sequence
attttcaagatttattctta

SEQ ID NO: 241531 - DNA, 20 bp, Artificial sequence
  SiRNA target sequence
ttttcaagatttattcttaa

SEQ ID NO: 241532 - DNA, 20 bp, Artificial sequence
  SiRNA target sequence
tttcaagatttattcttaag

SEQ ID NO: 241533 - DNA, 20 bp, Artificial sequence
  SiRNA target sequence
ttcaagatttattcttaaga

SEQ ID NO: 241534 - DNA, 20 bp, Artificial sequence
  SiRNA target sequence
tcaagatttattcttaagac

SEQ ID NO: 241535 - DNA, 20 bp, Artificial sequence
  SiRNA target sequence
caagatttattcttaagacc

SEQ ID NO: 241536 - DNA, 20 bp, Artificial sequence
  SiRNA target sequence
aagatttattcttaagaccg

SEQ ID NO: 241537 - DNA, 20 bp, Artificial sequence
  SiRNA target sequence
agatttattcttaagaccga

SEQ ID NO: 241538 - DNA, 20 bp, Artificial sequence
  SiRNA target sequence
gatttattcttaagaccgat

SEQ ID NO: 241539 - DNA, 20 bp, Artificial sequence
  SiRNA target sequence
atttattcttaagaccgatg

SEQ ID NO: 241540 - DNA, 20 bp, Artificial sequence
  SiRNA target sequence
tttattcttaagaccgatgg

SEQ ID NO: 241541 - DNA, 20 bp, Artificial sequence
  SiRNA target sequence
ttattcttaagaccgatgga

SEQ ID NO: 241542 - DNA, 20 bp, Artificial sequence
  SiRNA target sequence
tattcttaagaccgatggag

SEQ ID NO: 241543 - DNA, 20 bp, Artificial sequence
  SiRNA target sequence
attcttaagaccgatggagc

SEQ ID NO: 241544 - DNA, 20 bp, Artificial sequence
  SiRNA target sequence
ttcttaagaccgatggagct

SEQ ID NO: 241545 - DNA, 20 bp, Artificial sequence
  SiRNA target sequence
tcttaagaccgatggagctg

SEQ ID NO: 241546 - DNA, 20 bp, Artificial sequence
  SiRNA target sequence
cttaagaccgatggagctgt

SEQ ID NO: 241547 - DNA, 20 bp, Artificial sequence
  SiRNA target sequence
ttaagaccgatggagctgtg

SEQ ID NO: 241548 - DNA, 20 bp, Artificial sequence
  SiRNA target sequence
taagaccgatggagctgtgc

SEQ ID NO: 241549 - DNA, 20 bp, Artificial sequence
  SiRNA target sequence
aagaccgatggagctgtgcg

SEQ ID NO: 241550 - DNA, 20 bp, Artificial sequence
  SiRNA target sequence
agaccgatggagctgtgcgc

SEQ ID NO: 241551 - DNA, 20 bp, Artificial sequence
  SiRNA target sequence
gaccgatggagctgtgcgca

SEQ ID NO: 241552 - DNA, 20 bp, Artificial sequence
  SiRNA target sequence
accgatggagctgtgcgcaa

SEQ ID NO: 241553 - DNA, 20 bp, Artificial sequence
  SiRNA target sequence
ccgatggagctgtgcgcaaa

SEQ ID NO: 241554 - DNA, 20 bp, Artificial sequence
  SiRNA target sequence
cgatggagctgtgcgcaaat

SEQ ID NO: 241555 - DNA, 20 bp, Artificial sequence
  SiRNA target sequence
gatggagctgtgcgcaaatt

SEQ ID NO: 241556 - DNA, 20 bp, Artificial sequence
  SiRNA target sequence
atggagctgtgcgcaaattg

SEQ ID NO: 241557 - DNA, 20 bp, Artificial sequence
  SiRNA target sequence
tggagctgtgcgcaaattgt

SEQ ID NO: 241558 - DNA, 20 bp, Artificial sequence
  SiRNA target sequence
ggagctgtgcgcaaattgta

SEQ ID NO: 241559 - DNA, 20 bp, Artificial sequence
  SiRNA target sequence
gagctgtgcgcaaattgtaa

SEQ ID NO: 241560 - DNA, 20 bp, Artificial sequence
  SiRNA target sequence
agctgtgcgcaaattgtaaa

SEQ ID NO: 241561 - DNA, 20 bp, Artificial sequence
  SiRNA target sequence
gctgtgcgcaaattgtaaaa

SEQ ID NO: 241562 - DNA, 20 bp, Artificial sequence
  SiRNA target sequence
ctgtgcgcaaattgtaaaaa

SEQ ID NO: 241563 - DNA, 20 bp, Artificial sequence
  SiRNA target sequence
tgtgcgcaaattgtaaaaag

SEQ ID NO: 241564 - DNA, 20 bp, Artificial sequence
  SiRNA target sequence
gtgcgcaaattgtaaaaaga

SEQ ID NO: 241565 - DNA, 20 bp, Artificial sequence
  SiRNA target sequence
tgcgcaaattgtaaaaagaa

SEQ ID NO: 241566 - DNA, 20 bp, Artificial sequence
  SiRNA target sequence
gcgcaaattgtaaaaagaaa

SEQ ID NO: 241567 - DNA, 20 bp, Artificial sequence
  SiRNA target sequence
cgcaaattgtaaaaagaaag

SEQ ID NO: 241568 - DNA, 20 bp, Artificial sequence
  SiRNA target sequence
gcaaattgtaaaaagaaagt

SEQ ID NO: 241569 - DNA, 20 bp, Artificial sequence
  SiRNA target sequence
caaattgtaaaaagaaagtc

SEQ ID NO: 241570 - DNA, 20 bp, Artificial sequence
  SiRNA target sequence
aaattgtaaaaagaaagtcc

SEQ ID NO: 241571 - DNA, 20 bp, Artificial sequence
  SiRNA target sequence
aattgtaaaaagaaagtcct

SEQ ID NO: 241572 - DNA, 20 bp, Artificial sequence
  SiRNA target sequence
attgtaaaaagaaagtcctg

SEQ ID NO: 241573 - DNA, 20 bp, Artificial sequence
  SiRNA target sequence
ttgtaaaaagaaagtcctga

SEQ ID NO: 241574 - DNA, 20 bp, Artificial sequence
  SiRNA target sequence
tgtaaaaagaaagtcctgaa

SEQ ID NO: 241575 - DNA, 20 bp, Artificial sequence
  SiRNA target sequence
gtaaaaagaaagtcctgaaa

SEQ ID NO: 241576 - DNA, 20 bp, Artificial sequence
  SiRNA target sequence
taaaaagaaagtcctgaaat

SEQ ID NO: 241577 - DNA, 20 bp, Artificial sequence
  SiRNA target sequence
aaaaagaaagtcctgaaatt

SEQ ID NO: 241578 - DNA, 20 bp, Artificial sequence
  SiRNA target sequence
aaaagaaagtcctgaaatta

SEQ ID NO: 241579 - DNA, 20 bp, Artificial sequence
  SiRNA target sequence
aaagaaagtcctgaaattag

SEQ ID NO: 241580 - DNA, 20 bp, Artificial sequence
  SiRNA target sequence
aagaaagtcctgaaattaga

SEQ ID NO: 241581 - DNA, 20 bp, Artificial sequence
  SiRNA target sequence
agaaagtcctgaaattagag

SEQ ID NO: 241582 - DNA, 20 bp, Artificial sequence
  SiRNA target sequence
gaaagtcctgaaattagagc

SEQ ID NO: 241583 - DNA, 20 bp, Artificial sequence
  SiRNA target sequence
aaagtcctgaaattagagcg

SEQ ID NO: 241584 - DNA, 20 bp, Artificial sequence
  SiRNA target sequence
aagtcctgaaattagagcgg

SEQ ID NO: 241585 - DNA, 20 bp, Artificial sequence
  SiRNA target sequence
agtcctgaaattagagcggt

SEQ ID NO: 241586 - DNA, 20 bp, Artificial sequence
  SiRNA target sequence
gtcctgaaattagagcggta

SEQ ID NO: 241587 - DNA, 20 bp, Artificial sequence
  SiRNA target sequence
tcctgaaattagagcggtaa

SEQ ID NO: 241588 - DNA, 20 bp, Artificial sequence
  SiRNA target sequence
cctgaaattagagcggtaaa

SEQ ID NO: 241589 - DNA, 20 bp, Artificial sequence
  SiRNA target sequence
ctgaaattagagcggtaaaa

SEQ ID NO: 241590 - DNA, 20 bp, Artificial sequence
  SiRNA target sequence
tgaaattagagcggtaaaaa

SEQ ID NO: 241591 - DNA, 20 bp, Artificial sequence
  SiRNA target sequence
gaaattagagcggtaaaaaa

SEQ ID NO: 241592 - DNA, 20 bp, Artificial sequence
  SiRNA target sequence
aaattagagcggtaaaaaat

SEQ ID NO: 241593 - DNA, 20 bp, Artificial sequence
  SiRNA target sequence
aattagagcggtaaaaaata

SEQ ID NO: 241594 - DNA, 20 bp, Artificial sequence
  SiRNA target sequence
attagagcggtaaaaaatat

SEQ ID NO: 241595 - DNA, 20 bp, Artificial sequence
  SiRNA target sequence
ttagagcggtaaaaaatata

SEQ ID NO: 241596 - DNA, 20 bp, Artificial sequence
  SiRNA target sequence
tagagcggtaaaaaatatag

SEQ ID NO: 241597 - DNA, 20 bp, Artificial sequence
  SiRNA target sequence
agagcggtaaaaaatatagc

SEQ ID NO: 241598 - DNA, 20 bp, Artificial sequence
  SiRNA target sequence
gagcggtaaaaaatatagca

SEQ ID NO: 241599 - DNA, 20 bp, Artificial sequence
  SiRNA target sequence
agcggtaaaaaatatagcag

SEQ ID NO: 241600 - DNA, 20 bp, Artificial sequence
  SiRNA target sequence
gcggtaaaaaatatagcagc

SEQ ID NO: 241601 - DNA, 20 bp, Artificial sequence
  SiRNA target sequence
cggtaaaaaatatagcagca

SEQ ID NO: 241602 - DNA, 20 bp, Artificial sequence
  SiRNA target sequence
ggtaaaaaatatagcagcaa

SEQ ID NO: 241603 - DNA, 20 bp, Artificial sequence
  SiRNA target sequence
gtaaaaaatatagcagcaat

SEQ ID NO: 241604 - DNA, 20 bp, Artificial sequence
  SiRNA target sequence
taaaaaatatagcagcaata

SEQ ID NO: 241605 - DNA, 20 bp, Artificial sequence
  SiRNA target sequence
aaaaaatatagcagcaatag

SEQ ID NO: 241606 - DNA, 20 bp, Artificial sequence
  SiRNA target sequence
aaaaatatagcagcaatagg

SEQ ID NO: 241607 - DNA, 20 bp, Artificial sequence
  SiRNA target sequence
aaaatatagcagcaataggg

SEQ ID NO: 241608 - DNA, 20 bp, Artificial sequence
  SiRNA target sequence
aaatatagcagcaatagggg

SEQ ID NO: 241609 - DNA, 20 bp, Artificial sequence
  SiRNA target sequence
aatatagcagcaatagggga

SEQ ID NO: 241610 - DNA, 20 bp, Artificial sequence
  SiRNA target sequence
atatagcagcaataggggag

SEQ ID NO: 241611 - DNA, 20 bp, Artificial sequence
  SiRNA target sequence
tatagcagcaataggggagg

SEQ ID NO: 241612 - DNA, 20 bp, Artificial sequence
  SiRNA target sequence
atagcagcaataggggaggc

SEQ ID NO: 241613 - DNA, 20 bp, Artificial sequence
  SiRNA target sequence
tagcagcaataggggaggca

SEQ ID NO: 241614 - DNA, 20 bp, Artificial sequence
  SiRNA target sequence
agcagcaataggggaggcaa

SEQ ID NO: 241615 - DNA, 20 bp, Artificial sequence
  SiRNA target sequence
gcagcaataggggaggcaat

SEQ ID NO: 241616 - DNA, 20 bp, Artificial sequence
  SiRNA target sequence
cagcaataggggaggcaata

SEQ ID NO: 241617 - DNA, 20 bp, Artificial sequence
  SiRNA target sequence
agcaataggggaggcaatag

SEQ ID NO: 241618 - DNA, 20 bp, Artificial sequence
  SiRNA target sequence
gcaataggggaggcaataga

SEQ ID NO: 241619 - DNA, 20 bp, Artificial sequence
  SiRNA target sequence
caataggggaggcaatagat

SEQ ID NO: 241620 - DNA, 20 bp, Artificial sequence
  SiRNA target sequence
aataggggaggcaatagata

SEQ ID NO: 241621 - DNA, 20 bp, Artificial sequence
  SiRNA target sequence
ataggggaggcaatagatag

SEQ ID NO: 241622 - DNA, 20 bp, Artificial sequence
  SiRNA target sequence
taggggaggcaatagataga

SEQ ID NO: 241623 - DNA, 20 bp, Artificial sequence
  SiRNA target sequence
aggggaggcaatagatagat

SEQ ID NO: 241624 - DNA, 20 bp, Artificial sequence
  SiRNA target sequence
ggggaggcaatagatagata

SEQ ID NO: 241625 - DNA, 20 bp, Artificial sequence
  SiRNA target sequence
gggaggcaatagatagataa

SEQ ID NO: 241626 - DNA, 20 bp, Artificial sequence
  SiRNA target sequence
ggaggcaatagatagataaa

SEQ ID NO: 241627 - DNA, 20 bp, Artificial sequence
  SiRNA target sequence
gaggcaatagatagataaaa

SEQ ID NO: 241628 - DNA, 20 bp, Artificial sequence
  SiRNA target sequence
aggcaatagatagataaaag

SEQ ID NO: 241629 - DNA, 20 bp, Artificial sequence
  SiRNA target sequence
ggcaatagatagataaaaga

SEQ ID NO: 241630 - DNA, 20 bp, Artificial sequence
  SiRNA target sequence
gcaatagatagataaaagat

SEQ ID NO: 241631 - DNA, 20 bp, Artificial sequence
  SiRNA target sequence
caatagatagataaaagatc

SEQ ID NO: 241632 - DNA, 20 bp, Artificial sequence
  SiRNA target sequence
aatagatagataaaagatcc

SEQ ID NO: 241633 - DNA, 20 bp, Artificial sequence
  SiRNA target sequence
atagatagataaaagatcct

SEQ ID NO: 241634 - DNA, 20 bp, Artificial sequence
  SiRNA target sequence
tagatagataaaagatcctt

SEQ ID NO: 241635 - DNA, 20 bp, Artificial sequence
  SiRNA target sequence
agatagataaaagatccttg

SEQ ID NO: 241636 - DNA, 20 bp, Artificial sequence
  SiRNA target sequence
gatagataaaagatccttga

SEQ ID NO: 241637 - DNA, 20 bp, Artificial sequence
  SiRNA target sequence
atagataaaagatccttgat

SEQ ID NO: 241638 - DNA, 20 bp, Artificial sequence
  SiRNA target sequence
tagataaaagatccttgatg

SEQ ID NO: 241639 - DNA, 20 bp, Artificial sequence
  SiRNA target sequence
agataaaagatccttgatgc

SEQ ID NO: 241640 - DNA, 20 bp, Artificial sequence
  SiRNA target sequence
gataaaagatccttgatgca

SEQ ID NO: 241641 - DNA, 20 bp, Artificial sequence
  SiRNA target sequence
ataaaagatccttgatgcaa

SEQ ID NO: 241642 - DNA, 20 bp, Artificial sequence
  SiRNA target sequence
taaaagatccttgatgcaat

SEQ ID NO: 241643 - DNA, 20 bp, Artificial sequence
  SiRNA target sequence
aaaagatccttgatgcaatg

SEQ ID NO: 241644 - DNA, 20 bp, Artificial sequence
  SiRNA target sequence
aaagatccttgatgcaatgc

SEQ ID NO: 241645 - DNA, 20 bp, Artificial sequence
  SiRNA target sequence
aagatccttgatgcaatgcg

SEQ ID NO: 241646 - DNA, 20 bp, Artificial sequence
  SiRNA target sequence
agatccttgatgcaatgcga

SEQ ID NO: 241647 - DNA, 20 bp, Artificial sequence
  SiRNA target sequence
gatccttgatgcaatgcgat

SEQ ID NO: 241648 - DNA, 20 bp, Artificial sequence
  SiRNA target sequence
atccttgatgcaatgcgatt

SEQ ID NO: 241649 - DNA, 20 bp, Artificial sequence
  SiRNA target sequence
tccttgatgcaatgcgattt

SEQ ID NO: 241650 - DNA, 20 bp, Artificial sequence
  SiRNA target sequence
ccttgatgcaatgcgatttc

SEQ ID NO: 241651 - DNA, 20 bp, Artificial sequence
  SiRNA target sequence
cttgatgcaatgcgatttcc

SEQ ID NO: 241652 - DNA, 20 bp, Artificial sequence
  SiRNA target sequence
ttgatgcaatgcgatttcca

SEQ ID NO: 241653 - DNA, 20 bp, Artificial sequence
  SiRNA target sequence
tgatgcaatgcgatttccac

SEQ ID NO: 241654 - DNA, 20 bp, Artificial sequence
  SiRNA target sequence
gatgcaatgcgatttccacg

SEQ ID NO: 241655 - DNA, 20 bp, Artificial sequence
  SiRNA target sequence
atgcaatgcgatttccacgg

SEQ ID NO: 241656 - DNA, 20 bp, Artificial sequence
  SiRNA target sequence
tgcaatgcgatttccacgga

SEQ ID NO: 241657 - DNA, 20 bp, Artificial sequence
  SiRNA target sequence
gcaatgcgatttccacggat

SEQ ID NO: 241658 - DNA, 20 bp, Artificial sequence
  SiRNA target sequence
caatgcgatttccacggatt

SEQ ID NO: 241659 - DNA, 20 bp, Artificial sequence
  SiRNA target sequence
aatgcgatttccacggatta

SEQ ID NO: 241660 - DNA, 20 bp, Artificial sequence
  SiRNA target sequence
atgcgatttccacggattac

SEQ ID NO: 241661 - DNA, 20 bp, Artificial sequence
  SiRNA target sequence
tgcgatttccacggattaca

SEQ ID NO: 241662 - DNA, 20 bp, Artificial sequence
  SiRNA target sequence
gcgatttccacggattacaa

SEQ ID NO: 241663 - DNA, 20 bp, Artificial sequence
  SiRNA target sequence
cgatttccacggattacaaa

SEQ ID NO: 241664 - DNA, 20 bp, Artificial sequence
  SiRNA target sequence
gatttccacggattacaaag

SEQ ID NO: 241665 - DNA, 20 bp, Artificial sequence
  SiRNA target sequence
atttccacggattacaaagt

SEQ ID NO: 241666 - DNA, 20 bp, Artificial sequence
  SiRNA target sequence
tttccacggattacaaagtt

SEQ ID NO: 241667 - DNA, 20 bp, Artificial sequence
  SiRNA target sequence
ttccacggattacaaagtta

SEQ ID NO: 241668 - DNA, 20 bp, Artificial sequence
  SiRNA target sequence
tccacggattacaaagttat

SEQ ID NO: 241669 - DNA, 20 bp, Artificial sequence
  SiRNA target sequence
ccacggattacaaagttata

SEQ ID NO: 241670 - DNA, 20 bp, Artificial sequence
  SiRNA target sequence
cacggattacaaagttataa

SEQ ID NO: 241671 - DNA, 20 bp, Artificial sequence
  SiRNA target sequence
acggattacaaagttataaa

SEQ ID NO: 241672 - DNA, 20 bp, Artificial sequence
  SiRNA target sequence
cggattacaaagttataaaa

SEQ ID NO: 241673 - DNA, 20 bp, Artificial sequence
  SiRNA target sequence
ggattacaaagttataaaat

SEQ ID NO: 241674 - DNA, 20 bp, Artificial sequence
  SiRNA target sequence
gattacaaagttataaaata

SEQ ID NO: 241675 - DNA, 20 bp, Artificial sequence
  SiRNA target sequence
attacaaagttataaaataa

SEQ ID NO: 241676 - DNA, 20 bp, Artificial sequence
  SiRNA target sequence
ttacaaagttataaaataat

SEQ ID NO: 241677 - DNA, 20 bp, Artificial sequence
  SiRNA target sequence
tacaaagttataaaataatg

SEQ ID NO: 241678 - DNA, 20 bp, Artificial sequence
  SiRNA target sequence
acaaagttataaaataatga

SEQ ID NO: 241679 - DNA, 20 bp, Artificial sequence
  SiRNA target sequence
caaagttataaaataatgat

SEQ ID NO: 241680 - DNA, 20 bp, Artificial sequence
  SiRNA target sequence
aaagttataaaataatgata

SEQ ID NO: 241681 - DNA, 20 bp, Artificial sequence
  SiRNA target sequence
aagttataaaataatgatac

SEQ ID NO: 241682 - DNA, 20 bp, Artificial sequence
  SiRNA target sequence
agttataaaataatgataca

SEQ ID NO: 241683 - DNA, 20 bp, Artificial sequence
  SiRNA target sequence
gttataaaataatgatacag

SEQ ID NO: 241684 - DNA, 20 bp, Artificial sequence
  SiRNA target sequence
ttataaaataatgatacagc

SEQ ID NO: 241685 - DNA, 20 bp, Artificial sequence
  SiRNA target sequence
tataaaataatgatacagca

SEQ ID NO: 241686 - DNA, 20 bp, Artificial sequence
  SiRNA target sequence
ataaaataatgatacagcac

SEQ ID NO: 241687 - DNA, 20 bp, Artificial sequence
  SiRNA target sequence
taaaataatgatacagcact

SEQ ID NO: 241688 - DNA, 20 bp, Artificial sequence
  SiRNA target sequence
aaaataatgatacagcacta

SEQ ID NO: 241689 - DNA, 20 bp, Artificial sequence
  SiRNA target sequence
aaataatgatacagcactaa

SEQ ID NO: 241690 - DNA, 20 bp, Artificial sequence
  SiRNA target sequence
aataatgatacagcactaat

SEQ ID NO: 241691 - DNA, 20 bp, Artificial sequence
  SiRNA target sequence
ataatgatacagcactaatc

SEQ ID NO: 241692 - DNA, 20 bp, Artificial sequence
  SiRNA target sequence
taatgatacagcactaatcg

SEQ ID NO: 241693 - DNA, 20 bp, Artificial sequence
  SiRNA target sequence
aatgatacagcactaatcgt

SEQ ID NO: 241694 - DNA, 20 bp, Artificial sequence
  SiRNA target sequence
atgatacagcactaatcgtt

SEQ ID NO: 241695 - DNA, 20 bp, Artificial sequence
  SiRNA target sequence
tgatacagcactaatcgtta

SEQ ID NO: 241696 - DNA, 20 bp, Artificial sequence
  SiRNA target sequence
gatacagcactaatcgttaa

SEQ ID NO: 241697 - DNA, 20 bp, Artificial sequence
  SiRNA target sequence
atacagcactaatcgttaag

SEQ ID NO: 241698 - DNA, 20 bp, Artificial sequence
  SiRNA target sequence
tacagcactaatcgttaagg

SEQ ID NO: 241699 - DNA, 20 bp, Artificial sequence
  SiRNA target sequence
acagcactaatcgttaagga

SEQ ID NO: 241700 - DNA, 20 bp, Artificial sequence
  SiRNA target sequence
cagcactaatcgttaaggaa

SEQ ID NO: 241701 - DNA, 20 bp, Artificial sequence
  SiRNA target sequence
agcactaatcgttaaggaag

SEQ ID NO: 241702 - DNA, 20 bp, Artificial sequence
  SiRNA target sequence
gcactaatcgttaaggaagt

SEQ ID NO: 241703 - DNA, 20 bp, Artificial sequence
  SiRNA target sequence
cactaatcgttaaggaagtt

SEQ ID NO: 241704 - DNA, 20 bp, Artificial sequence
  SiRNA target sequence
actaatcgttaaggaagttg

SEQ ID NO: 241705 - DNA, 20 bp, Artificial sequence
  SiRNA target sequence
ctaatcgttaaggaagttgt

SEQ ID NO: 241706 - DNA, 20 bp, Artificial sequence
  SiRNA target sequence
taatcgttaaggaagttgtt

SEQ ID NO: 241707 - DNA, 20 bp, Artificial sequence
  SiRNA target sequence
aatcgttaaggaagttgtta

SEQ ID NO: 241708 - DNA, 20 bp, Artificial sequence
  SiRNA target sequence
atcgttaaggaagttgttac

SEQ ID NO: 241709 - DNA, 20 bp, Artificial sequence
  SiRNA target sequence
tcgttaaggaagttgttact

SEQ ID NO: 241710 - DNA, 20 bp, Artificial sequence
  SiRNA target sequence
cgttaaggaagttgttacta

SEQ ID NO: 241711 - DNA, 20 bp, Artificial sequence
  SiRNA target sequence
gttaaggaagttgttactaa

SEQ ID NO: 241712 - DNA, 20 bp, Artificial sequence
  SiRNA target sequence
ttaaggaagttgttactaaa

SEQ ID NO: 241713 - DNA, 20 bp, Artificial sequence
  SiRNA target sequence
taaggaagttgttactaaat

SEQ ID NO: 241714 - DNA, 20 bp, Artificial sequence
  SiRNA target sequence
aaggaagttgttactaaata

SEQ ID NO: 241715 - DNA, 20 bp, Artificial sequence
  SiRNA target sequence
aggaagttgttactaaatat

SEQ ID NO: 241716 - DNA, 20 bp, Artificial sequence
  SiRNA target sequence
ggaagttgttactaaatatt

SEQ ID NO: 241717 - DNA, 20 bp, Artificial sequence
  SiRNA target sequence
gaagttgttactaaatattt

SEQ ID NO: 241718 - DNA, 20 bp, Artificial sequence
  SiRNA target sequence
aagttgttactaaatatttt

SEQ ID NO: 241719 - DNA, 20 bp, Artificial sequence
  SiRNA target sequence
agttgttactaaatattttt

SEQ ID NO: 241720 - DNA, 20 bp, Artificial sequence
  SiRNA target sequence
gttgttactaaatatttttg

SEQ ID NO: 241721 - DNA, 20 bp, Artificial sequence
  SiRNA target sequence
ttgttactaaatatttttga

SEQ ID NO: 241722 - DNA, 20 bp, Artificial sequence
  SiRNA target sequence
tgttactaaatatttttgag

SEQ ID NO: 241723 - DNA, 20 bp, Artificial sequence
  SiRNA target sequence
gttactaaatatttttgaga

SEQ ID NO: 241724 - DNA, 20 bp, Artificial sequence
  SiRNA target sequence
ttactaaatatttttgagaa

SEQ ID NO: 241725 - DNA, 20 bp, Artificial sequence
  SiRNA target sequence
tactaaatatttttgagaat

SEQ ID NO: 241726 - DNA, 20 bp, Artificial sequence
  SiRNA target sequence
actaaatatttttgagaata

SEQ ID NO: 241727 - DNA, 20 bp, Artificial sequence
  SiRNA target sequence
ctaaatatttttgagaataa

SEQ ID NO: 241728 - DNA, 20 bp, Artificial sequence
  SiRNA target sequence
taaatatttttgagaataat

SEQ ID NO: 241729 - DNA, 20 bp, Artificial sequence
  SiRNA target sequence
aaatatttttgagaataatc

SEQ ID NO: 241730 - DNA, 20 bp, Artificial sequence
  SiRNA target sequence
aatatttttgagaataatct

SEQ ID NO: 241731 - DNA, 20 bp, Artificial sequence
  SiRNA target sequence
atatttttgagaataatctt

SEQ ID NO: 241732 - DNA, 20 bp, Artificial sequence
  SiRNA target sequence
tatttttgagaataatcttt

SEQ ID NO: 241733 - DNA, 20 bp, Artificial sequence
  SiRNA target sequence
atttttgagaataatctttc

SEQ ID NO: 241734 - DNA, 20 bp, Artificial sequence
  SiRNA target sequence
tttttgagaataatctttcg

SEQ ID NO: 241735 - DNA, 20 bp, Artificial sequence
  SiRNA target sequence
ttttgagaataatctttcgg

SEQ ID NO: 241736 - DNA, 20 bp, Artificial sequence
  SiRNA target sequence
tttgagaataatctttcgga

SEQ ID NO: 241737 - DNA, 20 bp, Artificial sequence
  SiRNA target sequence
ttgagaataatctttcggag

SEQ ID NO: 241738 - DNA, 20 bp, Artificial sequence
  SiRNA target sequence
tgagaataatctttcggagg

SEQ ID NO: 241739 - DNA, 20 bp, Artificial sequence
  SiRNA target sequence
gagaataatctttcggaggc

SEQ ID NO: 241740 - DNA, 20 bp, Artificial sequence
  SiRNA target sequence
agaataatctttcggaggca

SEQ ID NO: 241741 - DNA, 20 bp, Artificial sequence
  SiRNA target sequence
gaataatctttcggaggcat

SEQ ID NO: 241742 - DNA, 20 bp, Artificial sequence
  SiRNA target sequence
aataatctttcggaggcata

SEQ ID NO: 241743 - DNA, 20 bp, Artificial sequence
  SiRNA target sequence
ataatctttcggaggcatat

SEQ ID NO: 241744 - DNA, 20 bp, Artificial sequence
  SiRNA target sequence
taatctttcggaggcatatt

SEQ ID NO: 241745 - DNA, 20 bp, Artificial sequence
  SiRNA target sequence
aatctttcggaggcatatta

SEQ ID NO: 241746 - DNA, 20 bp, Artificial sequence
  SiRNA target sequence
atctttcggaggcatattat

SEQ ID NO: 241747 - DNA, 20 bp, Artificial sequence
  SiRNA target sequence
tctttcggaggcatattatt

SEQ ID NO: 241748 - DNA, 20 bp, Artificial sequence
  SiRNA target sequence
ctttcggaggcatattatta

SEQ ID NO: 241749 - DNA, 20 bp, Artificial sequence
  SiRNA target sequence
tttcggaggcatattattaa

SEQ ID NO: 241750 - DNA, 20 bp, Artificial sequence
  SiRNA target sequence
ttcggaggcatattattaat

SEQ ID NO: 241751 - DNA, 20 bp, Artificial sequence
  SiRNA target sequence
tcggaggcatattattaatt

SEQ ID NO: 241752 - DNA, 20 bp, Artificial sequence
  SiRNA target sequence
cggaggcatattattaattc

SEQ ID NO: 241753 - DNA, 20 bp, Artificial sequence
  SiRNA target sequence
ggaggcatattattaattct

SEQ ID NO: 241754 - DNA, 20 bp, Artificial sequence
  SiRNA target sequence
gaggcatattattaattctg

SEQ ID NO: 241755 - DNA, 20 bp, Artificial sequence
  SiRNA target sequence
aggcatattattaattctgc

SEQ ID NO: 241756 - DNA, 20 bp, Artificial sequence
  SiRNA target sequence
ggcatattattaattctgct

SEQ ID NO: 241757 - DNA, 20 bp, Artificial sequence
  SiRNA target sequence
gcatattattaattctgctt

SEQ ID NO: 241758 - DNA, 20 bp, Artificial sequence
  SiRNA target sequence
catattattaattctgcttc

SEQ ID NO: 241759 - DNA, 20 bp, Artificial sequence
  SiRNA target sequence
atattattaattctgcttcc

SEQ ID NO: 241760 - DNA, 20 bp, Artificial sequence
  SiRNA target sequence
tattattaattctgcttccc

SEQ ID NO: 241761 - DNA, 20 bp, Artificial sequence
  SiRNA target sequence
attattaattctgcttcccg

SEQ ID NO: 241762 - DNA, 20 bp, Artificial sequence
  SiRNA target sequence
ttattaattctgcttcccgt

SEQ ID NO: 241763 - DNA, 20 bp, Artificial sequence
  SiRNA target sequence
tattaattctgcttcccgta

SEQ ID NO: 241764 - DNA, 20 bp, Artificial sequence
  SiRNA target sequence
attaattctgcttcccgtag

SEQ ID NO: 241765 - DNA, 20 bp, Artificial sequence
  SiRNA target sequence
ttaattctgcttcccgtaga

SEQ ID NO: 241766 - DNA, 20 bp, Artificial sequence
  SiRNA target sequence
taattctgcttcccgtagat

SEQ ID NO: 241767 - DNA, 20 bp, Artificial sequence
  SiRNA target sequence
aattctgcttcccgtagata

SEQ ID NO: 241768 - DNA, 20 bp, Artificial sequence
  SiRNA target sequence
attctgcttcccgtagataa

SEQ ID NO: 241769 - DNA, 20 bp, Artificial sequence
  SiRNA target sequence
ttctgcttcccgtagataaa

SEQ ID NO: 241770 - DNA, 20 bp, Artificial sequence
  SiRNA target sequence
tctgcttcccgtagataaag

SEQ ID NO: 241771 - DNA, 20 bp, Artificial sequence
  SiRNA target sequence
ctgcttcccgtagataaaga

SEQ ID NO: 241772 - DNA, 20 bp, Artificial sequence
  SiRNA target sequence
tgcttcccgtagataaagaa

SEQ ID NO: 241773 - DNA, 20 bp, Artificial sequence
  SiRNA target sequence
gcttcccgtagataaagaat

SEQ ID NO: 241774 - DNA, 20 bp, Artificial sequence
  SiRNA target sequence
cttcccgtagataaagaatt

SEQ ID NO: 241775 - DNA, 20 bp, Artificial sequence
  SiRNA target sequence
ttcccgtagataaagaattt

SEQ ID NO: 241776 - DNA, 20 bp, Artificial sequence
  SiRNA target sequence
tcccgtagataaagaatttt

SEQ ID NO: 241777 - DNA, 20 bp, Artificial sequence
  SiRNA target sequence
cccgtagataaagaattttt

SEQ ID NO: 241778 - DNA, 20 bp, Artificial sequence
  SiRNA target sequence
ccgtagataaagaatttttt

SEQ ID NO: 241779 - DNA, 20 bp, Artificial sequence
  SiRNA target sequence
cgtagataaagaatttttta

SEQ ID NO: 241780 - DNA, 20 bp, Artificial sequence
  SiRNA target sequence
gtagataaagaattttttaa

SEQ ID NO: 241781 - DNA, 20 bp, Artificial sequence
  SiRNA target sequence
tagataaagaattttttaag

SEQ ID NO: 241782 - DNA, 20 bp, Artificial sequence
  SiRNA target sequence
agataaagaattttttaagg

SEQ ID NO: 241783 - DNA, 20 bp, Artificial sequence
  SiRNA target sequence
gataaagaattttttaagga

SEQ ID NO: 241784 - DNA, 20 bp, Artificial sequence
  SiRNA target sequence
ataaagaattttttaaggac

SEQ ID NO: 241785 - DNA, 20 bp, Artificial sequence
  SiRNA target sequence
taaagaattttttaaggaca

SEQ ID NO: 241786 - DNA, 20 bp, Artificial sequence
  SiRNA target sequence
aaagaattttttaaggacat

SEQ ID NO: 241787 - DNA, 20 bp, Artificial sequence
  SiRNA target sequence
aagaattttttaaggacata

SEQ ID NO: 241788 - DNA, 20 bp, Artificial sequence
  SiRNA target sequence
agaattttttaaggacatat

SEQ ID NO: 241789 - DNA, 20 bp, Artificial sequence
  SiRNA target sequence
gaattttttaaggacatatc

SEQ ID NO: 241790 - DNA, 20 bp, Artificial sequence
  SiRNA target sequence
aattttttaaggacatatca

SEQ ID NO: 241791 - DNA, 20 bp, Artificial sequence
  SiRNA target sequence
attttttaaggacatatcaa

SEQ ID NO: 241792 - DNA, 20 bp, Artificial sequence
  SiRNA target sequence
ttttttaaggacatatcaat

SEQ ID NO: 241793 - DNA, 20 bp, Artificial sequence
  SiRNA target sequence
tttttaaggacatatcaata

SEQ ID NO: 241794 - DNA, 20 bp, Artificial sequence
  SiRNA target sequence
ttttaaggacatatcaataa

SEQ ID NO: 241795 - DNA, 20 bp, Artificial sequence
  SiRNA target sequence
tttaaggacatatcaataaa

SEQ ID NO: 241796 - DNA, 20 bp, Artificial sequence
  SiRNA target sequence
ttaaggacatatcaataaat

SEQ ID NO: 241797 - DNA, 20 bp, Artificial sequence
  SiRNA target sequence
taaggacatatcaataaatc

SEQ ID NO: 241798 - DNA, 20 bp, Artificial sequence
  SiRNA target sequence
aaggacatatcaataaatcc

SEQ ID NO: 241799 - DNA, 20 bp, Artificial sequence
  SiRNA target sequence
aggacatatcaataaatcct

SEQ ID NO: 241800 - DNA, 20 bp, Artificial sequence
  SiRNA target sequence
ggacatatcaataaatcctg

SEQ ID NO: 241801 - DNA, 20 bp, Artificial sequence
  SiRNA target sequence
gacatatcaataaatcctgc

SEQ ID NO: 241802 - DNA, 20 bp, Artificial sequence
  SiRNA target sequence
acatatcaataaatcctgca

SEQ ID NO: 241803 - DNA, 20 bp, Artificial sequence
  SiRNA target sequence
catatcaataaatcctgcat

SEQ ID NO: 241804 - DNA, 20 bp, Artificial sequence
  SiRNA target sequence
atatcaataaatcctgcatt

SEQ ID NO: 241805 - DNA, 20 bp, Artificial sequence
  SiRNA target sequence
tatcaataaatcctgcatta

SEQ ID NO: 241806 - DNA, 20 bp, Artificial sequence
  SiRNA target sequence
atcaataaatcctgcattaa

SEQ ID NO: 241807 - DNA, 20 bp, Artificial sequence
  SiRNA target sequence
tcaataaatcctgcattaat

SEQ ID NO: 241808 - DNA, 20 bp, Artificial sequence
  SiRNA target sequence
caataaatcctgcattaata

SEQ ID NO: 241809 - DNA, 20 bp, Artificial sequence
  SiRNA target sequence
aataaatcctgcattaatag

SEQ ID NO: 241810 - DNA, 20 bp, Artificial sequence
  SiRNA target sequence
ataaatcctgcattaatagc

SEQ ID NO: 241811 - DNA, 20 bp, Artificial sequence
  SiRNA target sequence
taaatcctgcattaatagca

SEQ ID NO: 241812 - DNA, 20 bp, Artificial sequence
  SiRNA target sequence
aaatcctgcattaatagcat

SEQ ID NO: 241813 - DNA, 20 bp, Artificial sequence
  SiRNA target sequence
aatcctgcattaatagcata

SEQ ID NO: 241814 - DNA, 20 bp, Artificial sequence
  SiRNA target sequence
atcctgcattaatagcatag

SEQ ID NO: 241815 - DNA, 20 bp, Artificial sequence
  SiRNA target sequence
tcctgcattaatagcataga

SEQ ID NO: 241816 - DNA, 20 bp, Artificial sequence
  SiRNA target sequence
cctgcattaatagcatagat

SEQ ID NO: 241817 - DNA, 20 bp, Artificial sequence
  SiRNA target sequence
ctgcattaatagcatagatt

SEQ ID NO: 241818 - DNA, 20 bp, Artificial sequence
  SiRNA target sequence
tgcattaatagcatagatta

SEQ ID NO: 241819 - DNA, 20 bp, Artificial sequence
  SiRNA target sequence
gcattaatagcatagattaa

SEQ ID NO: 241820 - DNA, 20 bp, Artificial sequence
  SiRNA target sequence
cattaatagcatagattaat

SEQ ID NO: 241821 - DNA, 20 bp, Artificial sequence
  SiRNA target sequence
attaatagcatagattaatg

SEQ ID NO: 241822 - DNA, 20 bp, Artificial sequence
  SiRNA target sequence
ttaatagcatagattaatgc

SEQ ID NO: 241823 - DNA, 20 bp, Artificial sequence
  SiRNA target sequence
taatagcatagattaatgcc

SEQ ID NO: 241824 - DNA, 20 bp, Artificial sequence
  SiRNA target sequence
aatagcatagattaatgccg

SEQ ID NO: 241825 - DNA, 20 bp, Artificial sequence
  SiRNA target sequence
atagcatagattaatgccgc

SEQ ID NO: 241826 - DNA, 20 bp, Artificial sequence
  SiRNA target sequence
tagcatagattaatgccgct

SEQ ID NO: 241827 - DNA, 20 bp, Artificial sequence
  SiRNA target sequence
agcatagattaatgccgctg

SEQ ID NO: 241828 - DNA, 20 bp, Artificial sequence
  SiRNA target sequence
gcatagattaatgccgctgc

SEQ ID NO: 241829 - DNA, 20 bp, Artificial sequence
  SiRNA target sequence
catagattaatgccgctgca

SEQ ID NO: 241830 - DNA, 20 bp, Artificial sequence
  SiRNA target sequence
atagattaatgccgctgcac

SEQ ID NO: 241831 - DNA, 20 bp, Artificial sequence
  SiRNA target sequence
tagattaatgccgctgcaca

SEQ ID NO: 241832 - DNA, 20 bp, Artificial sequence
  SiRNA target sequence
agattaatgccgctgcacac

SEQ ID NO: 241833 - DNA, 20 bp, Artificial sequence
  SiRNA target sequence
gattaatgccgctgcacaca

SEQ ID NO: 241834 - DNA, 20 bp, Artificial sequence
  SiRNA target sequence
attaatgccgctgcacacat

SEQ ID NO: 241835 - DNA, 20 bp, Artificial sequence
  SiRNA target sequence
ttaatgccgctgcacacata

SEQ ID NO: 241836 - DNA, 20 bp, Artificial sequence
  SiRNA target sequence
taatgccgctgcacacatat

SEQ ID NO: 241837 - DNA, 20 bp, Artificial sequence
  SiRNA target sequence
aatgccgctgcacacatatt

SEQ ID NO: 241838 - DNA, 20 bp, Artificial sequence
  SiRNA target sequence
atgccgctgcacacatattt

SEQ ID NO: 241839 - DNA, 20 bp, Artificial sequence
  SiRNA target sequence
tgccgctgcacacatatttc

SEQ ID NO: 241840 - DNA, 20 bp, Artificial sequence
  SiRNA target sequence
gccgctgcacacatatttct

SEQ ID NO: 241841 - DNA, 20 bp, Artificial sequence
  SiRNA target sequence
ccgctgcacacatatttctt

SEQ ID NO: 241842 - DNA, 20 bp, Artificial sequence
  SiRNA target sequence
cgctgcacacatatttctta

SEQ ID NO: 241843 - DNA, 20 bp, Artificial sequence
  SiRNA target sequence
gctgcacacatatttcttaa

SEQ ID NO: 241844 - DNA, 20 bp, Artificial sequence
  SiRNA target sequence
ctgcacacatatttcttaaa

SEQ ID NO: 241845 - DNA, 20 bp, Artificial sequence
  SiRNA target sequence
tgcacacatatttcttaaaa

SEQ ID NO: 241846 - DNA, 20 bp, Artificial sequence
  SiRNA target sequence
gcacacatatttcttaaaaa

SEQ ID NO: 241847 - DNA, 20 bp, Artificial sequence
  SiRNA target sequence
cacacatatttcttaaaaat

SEQ ID NO: 241848 - DNA, 20 bp, Artificial sequence
  SiRNA target sequence
acacatatttcttaaaaatt

SEQ ID NO: 241849 - DNA, 20 bp, Artificial sequence
  SiRNA target sequence
cacatatttcttaaaaattt

SEQ ID NO: 241850 - DNA, 20 bp, Artificial sequence
  SiRNA target sequence
acatatttcttaaaaatttg

SEQ ID NO: 241851 - DNA, 20 bp, Artificial sequence
  SiRNA target sequence
catatttcttaaaaatttgg

SEQ ID NO: 241852 - DNA, 20 bp, Artificial sequence
  SiRNA target sequence
atatttcttaaaaatttgga

SEQ ID NO: 241853 - DNA, 20 bp, Artificial sequence
  SiRNA target sequence
tatttcttaaaaatttggat

SEQ ID NO: 241854 - DNA, 20 bp, Artificial sequence
  SiRNA target sequence
atttcttaaaaatttggatt

SEQ ID NO: 241855 - DNA, 20 bp, Artificial sequence
  SiRNA target sequence
tttcttaaaaatttggattg

SEQ ID NO: 241856 - DNA, 20 bp, Artificial sequence
  SiRNA target sequence
ttcttaaaaatttggattgt

SEQ ID NO: 241857 - DNA, 20 bp, Artificial sequence
  SiRNA target sequence
tcttaaaaatttggattgta

SEQ ID NO: 241858 - DNA, 20 bp, Artificial sequence
  SiRNA target sequence
cttaaaaatttggattgtaa

SEQ ID NO: 241859 - DNA, 20 bp, Artificial sequence
  SiRNA target sequence
ttaaaaatttggattgtaaa

SEQ ID NO: 241860 - DNA, 20 bp, Artificial sequence
  SiRNA target sequence
taaaaatttggattgtaaaa

SEQ ID NO: 241861 - DNA, 20 bp, Artificial sequence
  SiRNA target sequence
aaaaatttggattgtaaaag

SEQ ID NO: 241862 - DNA, 20 bp, Artificial sequence
  SiRNA target sequence
aaaatttggattgtaaaaga

SEQ ID NO: 241863 - DNA, 20 bp, Artificial sequence
  SiRNA target sequence
aaatttggattgtaaaagat

SEQ ID NO: 241864 - DNA, 20 bp, Artificial sequence
  SiRNA target sequence
aatttggattgtaaaagatc

SEQ ID NO: 241865 - DNA, 20 bp, Artificial sequence
  SiRNA target sequence
atttggattgtaaaagatca

SEQ ID NO: 241866 - DNA, 20 bp, Artificial sequence
  SiRNA target sequence
tttggattgtaaaagatcaa

SEQ ID NO: 241867 - DNA, 20 bp, Artificial sequence
  SiRNA target sequence
ttggattgtaaaagatcaaa

SEQ ID NO: 241868 - DNA, 20 bp, Artificial sequence
  SiRNA target sequence
tggattgtaaaagatcaaac

SEQ ID NO: 241869 - DNA, 20 bp, Artificial sequence
  SiRNA target sequence
ggattgtaaaagatcaaacg

SEQ ID NO: 241870 - DNA, 20 bp, Artificial sequence
  SiRNA target sequence
gattgtaaaagatcaaacga

SEQ ID NO: 241871 - DNA, 20 bp, Artificial sequence
  SiRNA target sequence
attgtaaaagatcaaacgag

SEQ ID NO: 241872 - DNA, 20 bp, Artificial sequence
  SiRNA target sequence
ttgtaaaagatcaaacgagg

SEQ ID NO: 241873 - DNA, 20 bp, Artificial sequence
  SiRNA target sequence
tgtaaaagatcaaacgagga

SEQ ID NO: 241874 - DNA, 20 bp, Artificial sequence
  SiRNA target sequence
gtaaaagatcaaacgaggat

SEQ ID NO: 241875 - DNA, 20 bp, Artificial sequence
  SiRNA target sequence
taaaagatcaaacgaggatg

SEQ ID NO: 241876 - DNA, 20 bp, Artificial sequence
  SiRNA target sequence
aaaagatcaaacgaggatgt

SEQ ID NO: 241877 - DNA, 20 bp, Artificial sequence
  SiRNA target sequence
aaagatcaaacgaggatgtc

SEQ ID NO: 241878 - DNA, 20 bp, Artificial sequence
  SiRNA target sequence
aagatcaaacgaggatgtcg

SEQ ID NO: 241879 - DNA, 20 bp, Artificial sequence
  SiRNA target sequence
agatcaaacgaggatgtcgt

SEQ ID NO: 241880 - DNA, 20 bp, Artificial sequence
  SiRNA target sequence
gatcaaacgaggatgtcgtt

SEQ ID NO: 241881 - DNA, 20 bp, Artificial sequence
  SiRNA target sequence
atcaaacgaggatgtcgttt

SEQ ID NO: 241882 - DNA, 20 bp, Artificial sequence
  SiRNA target sequence
tcaaacgaggatgtcgtttt

SEQ ID NO: 241883 - DNA, 20 bp, Artificial sequence
  SiRNA target sequence
caaacgaggatgtcgttttg

SEQ ID NO: 241884 - DNA, 20 bp, Artificial sequence
  SiRNA target sequence
aaacgaggatgtcgttttgt

SEQ ID NO: 241885 - DNA, 20 bp, Artificial sequence
  SiRNA target sequence
aacgaggatgtcgttttgtc

SEQ ID NO: 241886 - DNA, 20 bp, Artificial sequence
  SiRNA target sequence
acgaggatgtcgttttgtct

SEQ ID NO: 241887 - DNA, 20 bp, Artificial sequence
  SiRNA target sequence
cgaggatgtcgttttgtctt

SEQ ID NO: 241888 - DNA, 20 bp, Artificial sequence
  SiRNA target sequence
gaggatgtcgttttgtcttc

SEQ ID NO: 241889 - DNA, 20 bp, Artificial sequence
  SiRNA target sequence
aggatgtcgttttgtcttct

SEQ ID NO: 241890 - DNA, 20 bp, Artificial sequence
  SiRNA target sequence
ggatgtcgttttgtcttctt

SEQ ID NO: 241891 - DNA, 20 bp, Artificial sequence
  SiRNA target sequence
gatgtcgttttgtcttcttc

SEQ ID NO: 241892 - DNA, 20 bp, Artificial sequence
  SiRNA target sequence
atgtcgttttgtcttcttct

SEQ ID NO: 241893 - DNA, 20 bp, Artificial sequence
  SiRNA target sequence
tgtcgttttgtcttcttctt

SEQ ID NO: 241894 - DNA, 20 bp, Artificial sequence
  SiRNA target sequence
gtcgttttgtcttcttcttt

SEQ ID NO: 241895 - DNA, 20 bp, Artificial sequence
  SiRNA target sequence
tcgttttgtcttcttcttta

SEQ ID NO: 241896 - DNA, 20 bp, Artificial sequence
  SiRNA target sequence
cgttttgtcttcttctttat

SEQ ID NO: 241897 - DNA, 20 bp, Artificial sequence
  SiRNA target sequence
gttttgtcttcttctttatt

SEQ ID NO: 241898 - DNA, 20 bp, Artificial sequence
  SiRNA target sequence
ttttgtcttcttctttattt

SEQ ID NO: 241899 - DNA, 20 bp, Artificial sequence
  SiRNA target sequence
tttgtcttcttctttattta

SEQ ID NO: 241900 - DNA, 20 bp, Artificial sequence
  SiRNA target sequence
ttgtcttcttctttatttat

SEQ ID NO: 241901 - DNA, 20 bp, Artificial sequence
  SiRNA target sequence
tgtcttcttctttatttata

SEQ ID NO: 241902 - DNA, 20 bp, Artificial sequence
  SiRNA target sequence
gtcttcttctttatttatag

SEQ ID NO: 241903 - DNA, 20 bp, Artificial sequence
  SiRNA target sequence
tcttcttctttatttatagt

SEQ ID NO: 241904 - DNA, 20 bp, Artificial sequence
  SiRNA target sequence
cttcttctttatttatagtt

SEQ ID NO: 241905 - DNA, 20 bp, Artificial sequence
  SiRNA target sequence
ttcttctttatttatagttt

SEQ ID NO: 241906 - DNA, 20 bp, Artificial sequence
  SiRNA target sequence
tcttctttatttatagtttc

SEQ ID NO: 241907 - DNA, 20 bp, Artificial sequence
  SiRNA target sequence
cttctttatttatagtttcc

SEQ ID NO: 241908 - DNA, 20 bp, Artificial sequence
  SiRNA target sequence
ttctttatttatagtttcct

SEQ ID NO: 241909 - DNA, 20 bp, Artificial sequence
  SiRNA target sequence
tctttatttatagtttcctt

SEQ ID NO: 241910 - DNA, 20 bp, Artificial sequence
  SiRNA target sequence
ctttatttatagtttccttt

SEQ ID NO: 241911 - DNA, 20 bp, Artificial sequence
  SiRNA target sequence
tttatttatagtttccttta

SEQ ID NO: 241912 - DNA, 20 bp, Artificial sequence
  SiRNA target sequence
ttatttatagtttcctttat

SEQ ID NO: 241913 - DNA, 20 bp, Artificial sequence
  SiRNA target sequence
tatttatagtttcctttatt

SEQ ID NO: 241914 - DNA, 20 bp, Artificial sequence
  SiRNA target sequence
atttatagtttcctttattt

SEQ ID NO: 241915 - DNA, 20 bp, Artificial sequence
  SiRNA target sequence
tttatagtttcctttatttc

SEQ ID NO: 241916 - DNA, 20 bp, Artificial sequence
  SiRNA target sequence
ttatagtttcctttatttct

SEQ ID NO: 241917 - DNA, 20 bp, Artificial sequence
  SiRNA target sequence
tatagtttcctttatttctt

SEQ ID NO: 241918 - DNA, 20 bp, Artificial sequence
  SiRNA target sequence
atagtttcctttatttcttt

SEQ ID NO: 241919 - DNA, 20 bp, Artificial sequence
  SiRNA target sequence
tagtttcctttatttcttta

SEQ ID NO: 241920 - DNA, 20 bp, Artificial sequence
  SiRNA target sequence
agtttcctttatttctttag

SEQ ID NO: 241921 - DNA, 20 bp, Artificial sequence
  SiRNA target sequence
gtttcctttatttctttagt

SEQ ID NO: 241922 - DNA, 20 bp, Artificial sequence
  SiRNA target sequence
tttcctttatttctttagtt

SEQ ID NO: 241923 - DNA, 20 bp, Artificial sequence
  SiRNA target sequence
ttcctttatttctttagttt

SEQ ID NO: 241924 - DNA, 20 bp, Artificial sequence
  SiRNA target sequence
tcctttatttctttagtttt

SEQ ID NO: 241925 - DNA, 20 bp, Artificial sequence
  SiRNA target sequence
cctttatttctttagtttta

SEQ ID NO: 241926 - DNA, 20 bp, Artificial sequence
  SiRNA target sequence
ctttatttctttagttttaa

SEQ ID NO: 241927 - DNA, 20 bp, Artificial sequence
  SiRNA target sequence
tttatttctttagttttaag

SEQ ID NO: 241928 - DNA, 20 bp, Artificial sequence
  SiRNA target sequence
ttatttctttagttttaaga

SEQ ID NO: 241929 - DNA, 20 bp, Artificial sequence
  SiRNA target sequence
tatttctttagttttaagag

SEQ ID NO: 241930 - DNA, 20 bp, Artificial sequence
  SiRNA target sequence
atttctttagttttaagagg

SEQ ID NO: 241931 - DNA, 20 bp, Artificial sequence
  SiRNA target sequence
tttctttagttttaagagga

SEQ ID NO: 241932 - DNA, 20 bp, Artificial sequence
  SiRNA target sequence
ttctttagttttaagaggaa

SEQ ID NO: 241933 - DNA, 20 bp, Artificial sequence
  SiRNA target sequence
tctttagttttaagaggaat

SEQ ID NO: 241934 - DNA, 20 bp, Artificial sequence
  SiRNA target sequence
ctttagttttaagaggaata

SEQ ID NO: 241935 - DNA, 20 bp, Artificial sequence
  SiRNA target sequence
tttagttttaagaggaatat

SEQ ID NO: 241936 - DNA, 20 bp, Artificial sequence
  SiRNA target sequence
ttagttttaagaggaatata

SEQ ID NO: 241937 - DNA, 20 bp, Artificial sequence
  SiRNA target sequence
tagttttaagaggaatataa

SEQ ID NO: 241938 - DNA, 20 bp, Artificial sequence
  SiRNA target sequence
agttttaagaggaatataac

SEQ ID NO: 241939 - DNA, 20 bp, Artificial sequence
  SiRNA target sequence
gttttaagaggaatataact

SEQ ID NO: 241940 - DNA, 20 bp, Artificial sequence
  SiRNA target sequence
ttttaagaggaatataactt

SEQ ID NO: 241941 - DNA, 20 bp, Artificial sequence
  SiRNA target sequence
tttaagaggaatataacttt

SEQ ID NO: 241942 - DNA, 20 bp, Artificial sequence
  SiRNA target sequence
ttaagaggaatataactttt

SEQ ID NO: 241943 - DNA, 20 bp, Artificial sequence
  SiRNA target sequence
taagaggaatataacttttt

SEQ ID NO: 241944 - DNA, 20 bp, Artificial sequence
  SiRNA target sequence
aagaggaatataacttttta

SEQ ID NO: 241945 - DNA, 20 bp, Artificial sequence
  SiRNA target sequence
agaggaatataactttttaa

SEQ ID NO: 241946 - DNA, 20 bp, Artificial sequence
  SiRNA target sequence
gaggaatataactttttaaa

SEQ ID NO: 241947 - DNA, 20 bp, Artificial sequence
  SiRNA target sequence
aggaatataactttttaaaa

SEQ ID NO: 241948 - DNA, 20 bp, Artificial sequence
  SiRNA target sequence
ggaatataactttttaaaaa

SEQ ID NO: 241949 - DNA, 20 bp, Artificial sequence
  SiRNA target sequence
gaatataactttttaaaaag

SEQ ID NO: 241950 - DNA, 20 bp, Artificial sequence
  SiRNA target sequence
aatataactttttaaaaagt

SEQ ID NO: 241951 - DNA, 20 bp, Artificial sequence
  SiRNA target sequence
atataactttttaaaaagta

SEQ ID NO: 241952 - DNA, 20 bp, Artificial sequence
  SiRNA target sequence
tataactttttaaaaagtaa

SEQ ID NO: 241953 - DNA, 20 bp, Artificial sequence
  SiRNA target sequence
ataactttttaaaaagtaaa

SEQ ID NO: 241954 - DNA, 20 bp, Artificial sequence
  SiRNA target sequence
taactttttaaaaagtaaat

SEQ ID NO: 241955 - DNA, 20 bp, Artificial sequence
  SiRNA target sequence
aactttttaaaaagtaaatt

SEQ ID NO: 241956 - DNA, 20 bp, Artificial sequence
  SiRNA target sequence
actttttaaaaagtaaatta

SEQ ID NO: 241957 - DNA, 20 bp, Artificial sequence
  SiRNA target sequence
ctttttaaaaagtaaattaa

SEQ ID NO: 241958 - DNA, 20 bp, Artificial sequence
  SiRNA target sequence
tttttaaaaagtaaattaat

SEQ ID NO: 241959 - DNA, 20 bp, Artificial sequence
  SiRNA target sequence
ttttaaaaagtaaattaatg

SEQ ID NO: 241960 - DNA, 20 bp, Artificial sequence
  SiRNA target sequence
tttaaaaagtaaattaatgt

SEQ ID NO: 241961 - DNA, 20 bp, Artificial sequence
  SiRNA target sequence
ttaaaaagtaaattaatgta

SEQ ID NO: 241962 - DNA, 20 bp, Artificial sequence
  SiRNA target sequence
taaaaagtaaattaatgtag

SEQ ID NO: 241963 - DNA, 20 bp, Artificial sequence
  SiRNA target sequence
aaaaagtaaattaatgtagt

SEQ ID NO: 241964 - DNA, 20 bp, Artificial sequence
  SiRNA target sequence
aaaagtaaattaatgtagtt

SEQ ID NO: 241965 - DNA, 20 bp, Artificial sequence
  SiRNA target sequence
aaagtaaattaatgtagtta

SEQ ID NO: 241966 - DNA, 20 bp, Artificial sequence
  SiRNA target sequence
aagtaaattaatgtagttac

SEQ ID NO: 241967 - DNA, 20 bp, Artificial sequence
  SiRNA target sequence
agtaaattaatgtagttaca

SEQ ID NO: 241968 - DNA, 20 bp, Artificial sequence
  SiRNA target sequence
gtaaattaatgtagttacaa

SEQ ID NO: 241969 - DNA, 20 bp, Artificial sequence
  SiRNA target sequence
taaattaatgtagttacaaa

SEQ ID NO: 241970 - DNA, 20 bp, Artificial sequence
  SiRNA target sequence
aaattaatgtagttacaaaa

SEQ ID NO: 241971 - DNA, 20 bp, Artificial sequence
  SiRNA target sequence
aattaatgtagttacaaaag

SEQ ID NO: 241972 - DNA, 20 bp, Artificial sequence
  SiRNA target sequence
attaatgtagttacaaaaga

SEQ ID NO: 241973 - DNA, 20 bp, Artificial sequence
  SiRNA target sequence
ttaatgtagttacaaaagac

SEQ ID NO: 241974 - DNA, 20 bp, Artificial sequence
  SiRNA target sequence
taatgtagttacaaaagaca

SEQ ID NO: 241975 - DNA, 20 bp, Artificial sequence
  SiRNA target sequence
aatgtagttacaaaagacaa

SEQ ID NO: 241976 - DNA, 20 bp, Artificial sequence
  SiRNA target sequence
atgtagttacaaaagacaag

SEQ ID NO: 241977 - DNA, 20 bp, Artificial sequence
  SiRNA target sequence
tgtagttacaaaagacaaga

SEQ ID NO: 241978 - DNA, 20 bp, Artificial sequence
  SiRNA target sequence
gtagttacaaaagacaagat

SEQ ID NO: 241979 - DNA, 20 bp, Artificial sequence
  SiRNA target sequence
tagttacaaaagacaagatc

SEQ ID NO: 241980 - DNA, 20 bp, Artificial sequence
  SiRNA target sequence
agttacaaaagacaagatca

SEQ ID NO: 241981 - DNA, 20 bp, Artificial sequence
  SiRNA target sequence
gttacaaaagacaagatcaa

SEQ ID NO: 241982 - DNA, 20 bp, Artificial sequence
  SiRNA target sequence
ttacaaaagacaagatcaaa

SEQ ID NO: 241983 - DNA, 20 bp, Artificial sequence
  SiRNA target sequence
tacaaaagacaagatcaaaa

SEQ ID NO: 241984 - DNA, 20 bp, Artificial sequence
  SiRNA target sequence
acaaaagacaagatcaaaaa

SEQ ID NO: 241985 - DNA, 20 bp, Artificial sequence
  SiRNA target sequence
caaaagacaagatcaaaaaa

SEQ ID NO: 241986 - DNA, 20 bp, Artificial sequence
  SiRNA target sequence
aaaagacaagatcaaaaaaa

SEQ ID NO: 241987 - DNA, 20 bp, Artificial sequence
  SiRNA target sequence
aaagacaagatcaaaaaaaa

SEQ ID NO: 241988 - DNA, 20 bp, Artificial sequence
  SiRNA target sequence
aagacaagatcaaaaaaaac

SEQ ID NO: 241989 - DNA, 20 bp, Artificial sequence
  SiRNA target sequence
agacaagatcaaaaaaaaca

SEQ ID NO: 241990 - DNA, 20 bp, Artificial sequence
  SiRNA target sequence
gacaagatcaaaaaaaacaa

SEQ ID NO: 241991 - DNA, 20 bp, Artificial sequence
  SiRNA target sequence
acaagatcaaaaaaaacaaa

SEQ ID NO: 241992 - DNA, 20 bp, Artificial sequence
  SiRNA target sequence
caagatcaaaaaaaacaaac

SEQ ID NO: 241993 - DNA, 20 bp, Artificial sequence
  SiRNA target sequence
aagatcaaaaaaaacaaact

SEQ ID NO: 241994 - DNA, 20 bp, Artificial sequence
  SiRNA target sequence
agatcaaaaaaaacaaacta

SEQ ID NO: 241995 - DNA, 20 bp, Artificial sequence
  SiRNA target sequence
gatcaaaaaaaacaaactac

SEQ ID NO: 241996 - DNA, 20 bp, Artificial sequence
  SiRNA target sequence
atcaaaaaaaacaaactact

SEQ ID NO: 241997 - DNA, 20 bp, Artificial sequence
  SiRNA target sequence
tcaaaaaaaacaaactacta

SEQ ID NO: 241998 - DNA, 20 bp, Artificial sequence
  SiRNA target sequence
caaaaaaaacaaactactac

SEQ ID NO: 241999 - DNA, 20 bp, Artificial sequence
  SiRNA target sequence
aaaaaaaacaaactactacc

SEQ ID NO: 242000 - DNA, 20 bp, Artificial sequence
  SiRNA target sequence
aaaaaaacaaactactaccg

SEQ ID NO: 242001 - DNA, 20 bp, Artificial sequence
  SiRNA target sequence
aaaaaacaaactactaccgt

SEQ ID NO: 242002 - DNA, 20 bp, Artificial sequence
  SiRNA target sequence
aaaaacaaactactaccgtc

SEQ ID NO: 242003 - DNA, 20 bp, Artificial sequence
  SiRNA target sequence
aaaacaaactactaccgtca

SEQ ID NO: 242004 - DNA, 20 bp, Artificial sequence
  SiRNA target sequence
aaacaaactactaccgtcaa

SEQ ID NO: 242005 - DNA, 20 bp, Artificial sequence
  SiRNA target sequence
aacaaactactaccgtcaat

SEQ ID NO: 242006 - DNA, 20 bp, Artificial sequence
  SiRNA target sequence
acaaactactaccgtcaatt

SEQ ID NO: 242007 - DNA, 20 bp, Artificial sequence
  SiRNA target sequence
caaactactaccgtcaattt

SEQ ID NO: 242008 - DNA, 20 bp, Artificial sequence
  SiRNA target sequence
aaactactaccgtcaatttt

SEQ ID NO: 242009 - DNA, 20 bp, Artificial sequence
  SiRNA target sequence
aactactaccgtcaatttta

SEQ ID NO: 242010 - DNA, 20 bp, Artificial sequence
  SiRNA target sequence
actactaccgtcaattttat

SEQ ID NO: 242011 - DNA, 20 bp, Artificial sequence
  SiRNA target sequence
ctactaccgtcaattttatc

SEQ ID NO: 242012 - DNA, 20 bp, Artificial sequence
  SiRNA target sequence
tactaccgtcaattttatca

SEQ ID NO: 242013 - DNA, 20 bp, Artificial sequence
  SiRNA target sequence
actaccgtcaattttatcat

SEQ ID NO: 242014 - DNA, 20 bp, Artificial sequence
  SiRNA target sequence
ctaccgtcaattttatcatg

SEQ ID NO: 242015 - DNA, 20 bp, Artificial sequence
  SiRNA target sequence
taccgtcaattttatcatgc

SEQ ID NO: 242016 - DNA, 20 bp, Artificial sequence
  SiRNA target sequence
accgtcaattttatcatgca

SEQ ID NO: 242017 - DNA, 20 bp, Artificial sequence
  SiRNA target sequence
ccgtcaattttatcatgcaa

SEQ ID NO: 242018 - DNA, 20 bp, Artificial sequence
  SiRNA target sequence
cgtcaattttatcatgcaaa

SEQ ID NO: 242019 - DNA, 20 bp, Artificial sequence
  SiRNA target sequence
gtcaattttatcatgcaaac

SEQ ID NO: 242020 - DNA, 20 bp, Artificial sequence
  SiRNA target sequence
tcaattttatcatgcaaacc

SEQ ID NO: 242021 - DNA, 20 bp, Artificial sequence
  SiRNA target sequence
caattttatcatgcaaacct

SEQ ID NO: 242022 - DNA, 20 bp, Artificial sequence
  SiRNA target sequence
aattttatcatgcaaacctg

SEQ ID NO: 242023 - DNA, 20 bp, Artificial sequence
  SiRNA target sequence
attttatcatgcaaacctgc

SEQ ID NO: 242024 - DNA, 20 bp, Artificial sequence
  SiRNA target sequence
ttttatcatgcaaacctgca

SEQ ID NO: 242025 - DNA, 20 bp, Artificial sequence
  SiRNA target sequence
tttatcatgcaaacctgcag

SEQ ID NO: 242026 - DNA, 20 bp, Artificial sequence
  SiRNA target sequence
ttatcatgcaaacctgcagg

SEQ ID NO: 242027 - DNA, 20 bp, Artificial sequence
  SiRNA target sequence
tatcatgcaaacctgcagga

SEQ ID NO: 242028 - DNA, 20 bp, Artificial sequence
  SiRNA target sequence
atcatgcaaacctgcaggaa

SEQ ID NO: 242029 - DNA, 20 bp, Artificial sequence
  SiRNA target sequence
tcatgcaaacctgcaggaag

SEQ ID NO: 242030 - DNA, 20 bp, Artificial sequence
  SiRNA target sequence
catgcaaacctgcaggaagt

SEQ ID NO: 242031 - DNA, 20 bp, Artificial sequence
  SiRNA target sequence
atgcaaacctgcaggaagta

SEQ ID NO: 242032 - DNA, 20 bp, Artificial sequence
  SiRNA target sequence
tgcaaacctgcaggaagtat

SEQ ID NO: 242033 - DNA, 20 bp, Artificial sequence
  SiRNA target sequence
gcaaacctgcaggaagtata

SEQ ID NO: 242034 - DNA, 20 bp, Artificial sequence
  SiRNA target sequence
caaacctgcaggaagtatat

SEQ ID NO: 242035 - DNA, 20 bp, Artificial sequence
  SiRNA target sequence
aaacctgcaggaagtatatt

SEQ ID NO: 242036 - DNA, 20 bp, Artificial sequence
  SiRNA target sequence
aacctgcaggaagtatattt

SEQ ID NO: 242037 - DNA, 20 bp, Artificial sequence
  SiRNA target sequence
acctgcaggaagtatatttg

SEQ ID NO: 242038 - DNA, 20 bp, Artificial sequence
  SiRNA target sequence
cctgcaggaagtatatttgc

SEQ ID NO: 242039 - DNA, 20 bp, Artificial sequence
  SiRNA target sequence
ctgcaggaagtatatttgct

SEQ ID NO: 242040 - DNA, 20 bp, Artificial sequence
  SiRNA target sequence
tgcaggaagtatatttgcta

SEQ ID NO: 242041 - DNA, 20 bp, Artificial sequence
  SiRNA target sequence
gcaggaagtatatttgctaa

SEQ ID NO: 242042 - DNA, 20 bp, Artificial sequence
  SiRNA target sequence
caggaagtatatttgctaat

SEQ ID NO: 242043 - DNA, 20 bp, Artificial sequence
  SiRNA target sequence
aggaagtatatttgctaatt

SEQ ID NO: 242044 - DNA, 20 bp, Artificial sequence
  SiRNA target sequence
ggaagtatatttgctaattc

SEQ ID NO: 242045 - DNA, 20 bp, Artificial sequence
  SiRNA target sequence
gaagtatatttgctaattca

SEQ ID NO: 242046 - DNA, 20 bp, Artificial sequence
  SiRNA target sequence
aagtatatttgctaattcat

SEQ ID NO: 242047 - DNA, 20 bp, Artificial sequence
  SiRNA target sequence
agtatatttgctaattcatc

SEQ ID NO: 242048 - DNA, 20 bp, Artificial sequence
  SiRNA target sequence
gtatatttgctaattcatct

SEQ ID NO: 242049 - DNA, 20 bp, Artificial sequence
  SiRNA target sequence
tatatttgctaattcatctt

SEQ ID NO: 242050 - DNA, 20 bp, Artificial sequence
  SiRNA target sequence
atatttgctaattcatcttt

SEQ ID NO: 242051 - DNA, 20 bp, Artificial sequence
  SiRNA target sequence
tatttgctaattcatctttt

SEQ ID NO: 242052 - DNA, 20 bp, Artificial sequence
  SiRNA target sequence
atttgctaattcatctttta

SEQ ID NO: 242053 - DNA, 20 bp, Artificial sequence
  SiRNA target sequence
tttgctaattcatcttttat

SEQ ID NO: 242054 - DNA, 20 bp, Artificial sequence
  SiRNA target sequence
ttgctaattcatcttttata

SEQ ID NO: 242055 - DNA, 20 bp, Artificial sequence
  SiRNA target sequence
tgctaattcatcttttatat

SEQ ID NO: 242056 - DNA, 20 bp, Artificial sequence
  SiRNA target sequence
gctaattcatcttttatata

SEQ ID NO: 242057 - DNA, 20 bp, Artificial sequence
  SiRNA target sequence
ctaattcatcttttatataa

SEQ ID NO: 242058 - DNA, 20 bp, Artificial sequence
  SiRNA target sequence
taattcatcttttatataaa

SEQ ID NO: 242059 - DNA, 20 bp, Artificial sequence
  SiRNA target sequence
aattcatcttttatataaat

SEQ ID NO: 242060 - DNA, 20 bp, Artificial sequence
  SiRNA target sequence
attcatcttttatataaata

SEQ ID NO: 242061 - DNA, 20 bp, Artificial sequence
  SiRNA target sequence
ttcatcttttatataaataa

SEQ ID NO: 242062 - DNA, 20 bp, Artificial sequence
  SiRNA target sequence
tcatcttttatataaataaa

SEQ ID NO: 242063 - DNA, 20 bp, Artificial sequence
  SiRNA target sequence
catcttttatataaataaaa

SEQ ID NO: 242064 - DNA, 20 bp, Artificial sequence
  SiRNA target sequence
atcttttatataaataaaag

SEQ ID NO: 242065 - DNA, 20 bp, Artificial sequence
  SiRNA target sequence
tcttttatataaataaaagc

SEQ ID NO: 242066 - DNA, 20 bp, Artificial sequence
  SiRNA target sequence
cttttatataaataaaagct

SEQ ID NO: 242067 - DNA, 20 bp, Artificial sequence
  SiRNA target sequence
ttttatataaataaaagcta

SEQ ID NO: 242068 - DNA, 20 bp, Artificial sequence
  SiRNA target sequence
tttatataaataaaagctac

SEQ ID NO: 242069 - DNA, 20 bp, Artificial sequence
  SiRNA target sequence
ttatataaataaaagctaca

SEQ ID NO: 242070 - DNA, 20 bp, Artificial sequence
  SiRNA target sequence
tatataaataaaagctacag

SEQ ID NO: 242071 - DNA, 20 bp, Artificial sequence
  SiRNA target sequence
atataaataaaagctacaga

SEQ ID NO: 242072 - DNA, 20 bp, Artificial sequence
  SiRNA target sequence
tataaataaaagctacagaa

SEQ ID NO: 242073 - DNA, 20 bp, Artificial sequence
  SiRNA target sequence
ataaataaaagctacagaaa

SEQ ID NO: 242074 - DNA, 20 bp, Artificial sequence
  SiRNA target sequence
taaataaaagctacagaaat

SEQ ID NO: 242075 - DNA, 20 bp, Artificial sequence
  SiRNA target sequence
aaataaaagctacagaaata

SEQ ID NO: 242076 - DNA, 20 bp, Artificial sequence
  SiRNA target sequence
aataaaagctacagaaataa

SEQ ID NO: 242077 - DNA, 20 bp, Artificial sequence
  SiRNA target sequence
ataaaagctacagaaataat

SEQ ID NO: 242078 - DNA, 20 bp, Artificial sequence
  SiRNA target sequence
taaaagctacagaaataatc

SEQ ID NO: 242079 - DNA, 20 bp, Artificial sequence
  SiRNA target sequence
aaaagctacagaaataatca

SEQ ID NO: 242080 - DNA, 20 bp, Artificial sequence
  SiRNA target sequence
aaagctacagaaataatcat

SEQ ID NO: 242081 - DNA, 20 bp, Artificial sequence
  SiRNA target sequence
aagctacagaaataatcatt

SEQ ID NO: 242082 - DNA, 20 bp, Artificial sequence
  SiRNA target sequence
agctacagaaataatcattg

SEQ ID NO: 242083 - DNA, 20 bp, Artificial sequence
  SiRNA target sequence
gctacagaaataatcattga

SEQ ID NO: 242084 - DNA, 20 bp, Artificial sequence
  SiRNA target sequence
ctacagaaataatcattgaa

SEQ ID NO: 242085 - DNA, 20 bp, Artificial sequence
  SiRNA target sequence
tacagaaataatcattgaaa

SEQ ID NO: 242086 - DNA, 20 bp, Artificial sequence
  SiRNA target sequence
acagaaataatcattgaaat

SEQ ID NO: 242087 - DNA, 20 bp, Artificial sequence
  SiRNA target sequence
cagaaataatcattgaaatg

SEQ ID NO: 242088 - DNA, 20 bp, Artificial sequence
  SiRNA target sequence
agaaataatcattgaaatgg

SEQ ID NO: 242089 - DNA, 20 bp, Artificial sequence
  SiRNA target sequence
gaaataatcattgaaatggc

SEQ ID NO: 242090 - DNA, 20 bp, Artificial sequence
  SiRNA target sequence
aaataatcattgaaatggcg

SEQ ID NO: 242091 - DNA, 20 bp, Artificial sequence
  SiRNA target sequence
aataatcattgaaatggcgg

SEQ ID NO: 242092 - DNA, 20 bp, Artificial sequence
  SiRNA target sequence
ataatcattgaaatggcggt

SEQ ID NO: 242093 - DNA, 20 bp, Artificial sequence
  SiRNA target sequence
taatcattgaaatggcggtg

SEQ ID NO: 242094 - DNA, 20 bp, Artificial sequence
  SiRNA target sequence
aatcattgaaatggcggtga

SEQ ID NO: 242095 - DNA, 20 bp, Artificial sequence
  SiRNA target sequence
atcattgaaatggcggtgat

SEQ ID NO: 242096 - DNA, 20 bp, Artificial sequence
  SiRNA target sequence
tcattgaaatggcggtgatt

SEQ ID NO: 242097 - DNA, 20 bp, Artificial sequence
  SiRNA target sequence
cattgaaatggcggtgattg

SEQ ID NO: 242098 - DNA, 20 bp, Artificial sequence
  SiRNA target sequence
attgaaatggcggtgattgt

SEQ ID NO: 242099 - DNA, 20 bp, Artificial sequence
  SiRNA target sequence
ttgaaatggcggtgattgtg

SEQ ID NO: 242100 - DNA, 20 bp, Artificial sequence
  SiRNA target sequence
tgaaatggcggtgattgtgg

SEQ ID NO: 242101 - DNA, 20 bp, Artificial sequence
  SiRNA target sequence
gaaatggcggtgattgtgga

SEQ ID NO: 242102 - DNA, 20 bp, Artificial sequence
  SiRNA target sequence
aaatggcggtgattgtggaa

SEQ ID NO: 242103 - DNA, 20 bp, Artificial sequence
  SiRNA target sequence
aatggcggtgattgtggaaa

SEQ ID NO: 242104 - DNA, 20 bp, Artificial sequence
  SiRNA target sequence
atggcggtgattgtggaaaa

SEQ ID NO: 242105 - DNA, 20 bp, Artificial sequence
  SiRNA target sequence
tggcggtgattgtggaaaaa

SEQ ID NO: 242106 - DNA, 20 bp, Artificial sequence
  SiRNA target sequence
ggcggtgattgtggaaaaat

SEQ ID NO: 242107 - DNA, 20 bp, Artificial sequence
  SiRNA target sequence
gcggtgattgtggaaaaatt

SEQ ID NO: 242108 - DNA, 20 bp, Artificial sequence
  SiRNA target sequence
cggtgattgtggaaaaatta

SEQ ID NO: 242109 - DNA, 20 bp, Artificial sequence
  SiRNA target sequence
ggtgattgtggaaaaattag

SEQ ID NO: 242110 - DNA, 20 bp, Artificial sequence
  SiRNA target sequence
gtgattgtggaaaaattagg

SEQ ID NO: 242111 - DNA, 20 bp, Artificial sequence
  SiRNA target sequence
tgattgtggaaaaattagga

SEQ ID NO: 242112 - DNA, 20 bp, Artificial sequence
  SiRNA target sequence
gattgtggaaaaattaggaa

SEQ ID NO: 242113 - DNA, 20 bp, Artificial sequence
  SiRNA target sequence
attgtggaaaaattaggaac

SEQ ID NO: 242114 - DNA, 20 bp, Artificial sequence
  SiRNA target sequence
ttgtggaaaaattaggaaca

SEQ ID NO: 242115 - DNA, 20 bp, Artificial sequence
  SiRNA target sequence
tgtggaaaaattaggaacaa

SEQ ID NO: 242116 - DNA, 20 bp, Artificial sequence
  SiRNA target sequence
gtggaaaaattaggaacaat

SEQ ID NO: 242117 - DNA, 20 bp, Artificial sequence
  SiRNA target sequence
tggaaaaattaggaacaatt

SEQ ID NO: 242118 - DNA, 20 bp, Artificial sequence
  SiRNA target sequence
ggaaaaattaggaacaattt

SEQ ID NO: 242119 - DNA, 20 bp, Artificial sequence
  SiRNA target sequence
gaaaaattaggaacaatttc

SEQ ID NO: 242120 - DNA, 20 bp, Artificial sequence
  SiRNA target sequence
aaaaattaggaacaatttct

SEQ ID NO: 242121 - DNA, 20 bp, Artificial sequence
  SiRNA target sequence
aaaattaggaacaatttctt

SEQ ID NO: 242122 - DNA, 20 bp, Artificial sequence
  SiRNA target sequence
aaattaggaacaatttcttt

SEQ ID NO: 242123 - DNA, 20 bp, Artificial sequence
  SiRNA target sequence
aattaggaacaatttctttc

SEQ ID NO: 242124 - DNA, 20 bp, Artificial sequence
  SiRNA target sequence
attaggaacaatttctttca

SEQ ID NO: 242125 - DNA, 20 bp, Artificial sequence
  SiRNA target sequence
ttaggaacaatttctttcat

SEQ ID NO: 242126 - DNA, 20 bp, Artificial sequence
  SiRNA target sequence
taggaacaatttctttcatt

SEQ ID NO: 242127 - DNA, 20 bp, Artificial sequence
  SiRNA target sequence
aggaacaatttctttcattt

SEQ ID NO: 242128 - DNA, 20 bp, Artificial sequence
  SiRNA target sequence
ggaacaatttctttcatttc

SEQ ID NO: 242129 - DNA, 20 bp, Artificial sequence
  SiRNA target sequence
gaacaatttctttcatttca

SEQ ID NO: 242130 - DNA, 20 bp, Artificial sequence
  SiRNA target sequence
aacaatttctttcatttcat

SEQ ID NO: 242131 - DNA, 20 bp, Artificial sequence
  SiRNA target sequence
acaatttctttcatttcatc

SEQ ID NO: 242132 - DNA, 20 bp, Artificial sequence
  SiRNA target sequence
caatttctttcatttcatct

SEQ ID NO: 242133 - DNA, 20 bp, Artificial sequence
  SiRNA target sequence
aatttctttcatttcatctt

SEQ ID NO: 242134 - DNA, 20 bp, Artificial sequence
  SiRNA target sequence
atttctttcatttcatcttc

SEQ ID NO: 242135 - DNA, 20 bp, Artificial sequence
  SiRNA target sequence
tttctttcatttcatcttct

SEQ ID NO: 242136 - DNA, 20 bp, Artificial sequence
  SiRNA target sequence
ttctttcatttcatcttctg

SEQ ID NO: 242137 - DNA, 20 bp, Artificial sequence
  SiRNA target sequence
tctttcatttcatcttctgt

SEQ ID NO: 242138 - DNA, 20 bp, Artificial sequence
  SiRNA target sequence
ctttcatttcatcttctgta

SEQ ID NO: 242139 - DNA, 20 bp, Artificial sequence
  SiRNA target sequence
tttcatttcatcttctgtac

SEQ ID NO: 242140 - DNA, 20 bp, Artificial sequence
  SiRNA target sequence
ttcatttcatcttctgtaca

SEQ ID NO: 242141 - DNA, 20 bp, Artificial sequence
  SiRNA target sequence
tcatttcatcttctgtacaa

SEQ ID NO: 242142 - DNA, 20 bp, Artificial sequence
  SiRNA target sequence
catttcatcttctgtacaag

SEQ ID NO: 242143 - DNA, 20 bp, Artificial sequence
  SiRNA target sequence
atttcatcttctgtacaagc

SEQ ID NO: 242144 - DNA, 20 bp, Artificial sequence
  SiRNA target sequence
tttcatcttctgtacaagca

SEQ ID NO: 242145 - DNA, 20 bp, Artificial sequence
  SiRNA target sequence
ttcatcttctgtacaagcat

SEQ ID NO: 242146 - DNA, 20 bp, Artificial sequence
  SiRNA target sequence
tcatcttctgtacaagcatg

SEQ ID NO: 242147 - DNA, 20 bp, Artificial sequence
  SiRNA target sequence
catcttctgtacaagcatga

SEQ ID NO: 242148 - DNA, 20 bp, Artificial sequence
  SiRNA target sequence
atcttctgtacaagcatgat

SEQ ID NO: 242149 - DNA, 20 bp, Artificial sequence
  SiRNA target sequence
tcttctgtacaagcatgatt

SEQ ID NO: 242150 - DNA, 20 bp, Artificial sequence
  SiRNA target sequence
cttctgtacaagcatgattg

SEQ ID NO: 242151 - DNA, 20 bp, Artificial sequence
  SiRNA target sequence
ttctgtacaagcatgattgg

SEQ ID NO: 242152 - DNA, 20 bp, Artificial sequence
  SiRNA target sequence
tctgtacaagcatgattggc

SEQ ID NO: 242153 - DNA, 20 bp, Artificial sequence
  SiRNA target sequence
ctgtacaagcatgattggct

SEQ ID NO: 242154 - DNA, 20 bp, Artificial sequence
  SiRNA target sequence
tgtacaagcatgattggcta

SEQ ID NO: 242155 - DNA, 20 bp, Artificial sequence
  SiRNA target sequence
gtacaagcatgattggctaa

SEQ ID NO: 242156 - DNA, 20 bp, Artificial sequence
  SiRNA target sequence
tacaagcatgattggctaac

SEQ ID NO: 242157 - DNA, 20 bp, Artificial sequence
  SiRNA target sequence
acaagcatgattggctaacg

SEQ ID NO: 242158 - DNA, 20 bp, Artificial sequence
  SiRNA target sequence
caagcatgattggctaacgc

SEQ ID NO: 242159 - DNA, 20 bp, Artificial sequence
  SiRNA target sequence
aagcatgattggctaacgca

SEQ ID NO: 242160 - DNA, 20 bp, Artificial sequence
  SiRNA target sequence
agcatgattggctaacgcat

SEQ ID NO: 242161 - DNA, 20 bp, Artificial sequence
  SiRNA target sequence
gcatgattggctaacgcata

SEQ ID NO: 242162 - DNA, 20 bp, Artificial sequence
  SiRNA target sequence
catgattggctaacgcatat

SEQ ID NO: 242163 - DNA, 20 bp, Artificial sequence
  SiRNA target sequence
atgattggctaacgcatata

SEQ ID NO: 242164 - DNA, 20 bp, Artificial sequence
  SiRNA target sequence
tgattggctaacgcatataa

SEQ ID NO: 242165 - DNA, 20 bp, Artificial sequence
  SiRNA target sequence
gattggctaacgcatataaa

SEQ ID NO: 242166 - DNA, 20 bp, Artificial sequence
  SiRNA target sequence
attggctaacgcatataaag

SEQ ID NO: 242167 - DNA, 20 bp, Artificial sequence
  SiRNA target sequence
ttggctaacgcatataaagc

SEQ ID NO: 242168 - DNA, 20 bp, Artificial sequence
  SiRNA target sequence
tggctaacgcatataaagca

SEQ ID NO: 242169 - DNA, 20 bp, Artificial sequence
  SiRNA target sequence
ggctaacgcatataaagcaa

SEQ ID NO: 242170 - DNA, 20 bp, Artificial sequence
  SiRNA target sequence
gctaacgcatataaagcaaa

SEQ ID NO: 242171 - DNA, 20 bp, Artificial sequence
  SiRNA target sequence
ctaacgcatataaagcaaaa

SEQ ID NO: 242172 - DNA, 20 bp, Artificial sequence
  SiRNA target sequence
taacgcatataaagcaaaac

SEQ ID NO: 242173 - DNA, 20 bp, Artificial sequence
  SiRNA target sequence
aacgcatataaagcaaaacc

SEQ ID NO: 242174 - DNA, 20 bp, Artificial sequence
  SiRNA target sequence
acgcatataaagcaaaacca

SEQ ID NO: 242175 - DNA, 20 bp, Artificial sequence
  SiRNA target sequence
cgcatataaagcaaaaccaa

SEQ ID NO: 242176 - DNA, 20 bp, Artificial sequence
  SiRNA target sequence
gcatataaagcaaaaccaac

SEQ ID NO: 242177 - DNA, 20 bp, Artificial sequence
  SiRNA target sequence
catataaagcaaaaccaact

SEQ ID NO: 242178 - DNA, 20 bp, Artificial sequence
  SiRNA target sequence
atataaagcaaaaccaacta

SEQ ID NO: 242179 - DNA, 20 bp, Artificial sequence
  SiRNA target sequence
tataaagcaaaaccaactac

SEQ ID NO: 242180 - DNA, 20 bp, Artificial sequence
  SiRNA target sequence
ataaagcaaaaccaactact

SEQ ID NO: 242181 - DNA, 20 bp, Artificial sequence
  SiRNA target sequence
taaagcaaaaccaactacta

SEQ ID NO: 242182 - DNA, 20 bp, Artificial sequence
  SiRNA target sequence
aaagcaaaaccaactactag

SEQ ID NO: 242183 - DNA, 20 bp, Artificial sequence
  SiRNA target sequence
aagcaaaaccaactactaga

SEQ ID NO: 242184 - DNA, 20 bp, Artificial sequence
  SiRNA target sequence
agcaaaaccaactactagag

SEQ ID NO: 242185 - DNA, 20 bp, Artificial sequence
  SiRNA target sequence
gcaaaaccaactactagagt

SEQ ID NO: 242186 - DNA, 20 bp, Artificial sequence
  SiRNA target sequence
caaaaccaactactagagta

SEQ ID NO: 242187 - DNA, 20 bp, Artificial sequence
  SiRNA target sequence
aaaaccaactactagagtac

SEQ ID NO: 242188 - DNA, 20 bp, Artificial sequence
  SiRNA target sequence
aaaccaactactagagtact

SEQ ID NO: 242189 - DNA, 20 bp, Artificial sequence
  SiRNA target sequence
aaccaactactagagtactc

SEQ ID NO: 242190 - DNA, 20 bp, Artificial sequence
  SiRNA target sequence
accaactactagagtactcc

SEQ ID NO: 242191 - DNA, 20 bp, Artificial sequence
  SiRNA target sequence
ccaactactagagtactcca

SEQ ID NO: 242192 - DNA, 20 bp, Artificial sequence
  SiRNA target sequence
caactactagagtactccac

SEQ ID NO: 242193 - DNA, 20 bp, Artificial sequence
  SiRNA target sequence
aactactagagtactccaca

SEQ ID NO: 242194 - DNA, 20 bp, Artificial sequence
  SiRNA target sequence
actactagagtactccacaa

SEQ ID NO: 242195 - DNA, 20 bp, Artificial sequence
  SiRNA target sequence
ctactagagtactccacaac

SEQ ID NO: 242196 - DNA, 20 bp, Artificial sequence
  SiRNA target sequence
tactagagtactccacaact

SEQ ID NO: 242197 - DNA, 20 bp, Artificial sequence
  SiRNA target sequence
actagagtactccacaactc

SEQ ID NO: 242198 - DNA, 20 bp, Artificial sequence
  SiRNA target sequence
ctagagtactccacaactcc

SEQ ID NO: 242199 - DNA, 20 bp, Artificial sequence
  SiRNA target sequence
tagagtactccacaactccg

SEQ ID NO: 242200 - DNA, 20 bp, Artificial sequence
  SiRNA target sequence
agagtactccacaactccga

SEQ ID NO: 242201 - DNA, 20 bp, Artificial sequence
  SiRNA target sequence
gagtactccacaactccgat

SEQ ID NO: 242202 - DNA, 20 bp, Artificial sequence
  SiRNA target sequence
agtactccacaactccgata

SEQ ID NO: 242203 - DNA, 20 bp, Artificial sequence
  SiRNA target sequence
gtactccacaactccgataa

SEQ ID NO: 242204 - DNA, 20 bp, Artificial sequence
  SiRNA target sequence
tactccacaactccgataag

SEQ ID NO: 242205 - DNA, 20 bp, Artificial sequence
  SiRNA target sequence
actccacaactccgataaga

SEQ ID NO: 242206 - DNA, 20 bp, Artificial sequence
  SiRNA target sequence
ctccacaactccgataagat

SEQ ID NO: 242207 - DNA, 20 bp, Artificial sequence
  SiRNA target sequence
tccacaactccgataagatg

SEQ ID NO: 242208 - DNA, 20 bp, Artificial sequence
  SiRNA target sequence
ccacaactccgataagatgt

SEQ ID NO: 242209 - DNA, 20 bp, Artificial sequence
  SiRNA target sequence
cacaactccgataagatgta

SEQ ID NO: 242210 - DNA, 20 bp, Artificial sequence
  SiRNA target sequence
acaactccgataagatgtaa

SEQ ID NO: 242211 - DNA, 20 bp, Artificial sequence
  SiRNA target sequence
caactccgataagatgtaac

SEQ ID NO: 242212 - DNA, 20 bp, Artificial sequence
  SiRNA target sequence
aactccgataagatgtaaca

SEQ ID NO: 242213 - DNA, 20 bp, Artificial sequence
  SiRNA target sequence
actccgataagatgtaacat

SEQ ID NO: 242214 - DNA, 20 bp, Artificial sequence
  SiRNA target sequence
ctccgataagatgtaacata

SEQ ID NO: 242215 - DNA, 20 bp, Artificial sequence
  SiRNA target sequence
tccgataagatgtaacataa

SEQ ID NO: 242216 - DNA, 20 bp, Artificial sequence
  SiRNA target sequence
ccgataagatgtaacataaa

SEQ ID NO: 242217 - DNA, 20 bp, Artificial sequence
  SiRNA target sequence
cgataagatgtaacataaag

SEQ ID NO: 242218 - DNA, 20 bp, Artificial sequence
  SiRNA target sequence
gataagatgtaacataaagt

SEQ ID NO: 242219 - DNA, 20 bp, Artificial sequence
  SiRNA target sequence
ataagatgtaacataaagta

SEQ ID NO: 242220 - DNA, 20 bp, Artificial sequence
  SiRNA target sequence
taagatgtaacataaagtac

SEQ ID NO: 242221 - DNA, 20 bp, Artificial sequence
  SiRNA target sequence
aagatgtaacataaagtact

SEQ ID NO: 242222 - DNA, 20 bp, Artificial sequence
  SiRNA target sequence
agatgtaacataaagtactt

SEQ ID NO: 242223 - DNA, 20 bp, Artificial sequence
  SiRNA target sequence
gatgtaacataaagtactta

SEQ ID NO: 242224 - DNA, 20 bp, Artificial sequence
  SiRNA target sequence
atgtaacataaagtacttat

SEQ ID NO: 242225 - DNA, 20 bp, Artificial sequence
  SiRNA target sequence
tgtaacataaagtacttatc

SEQ ID NO: 242226 - DNA, 20 bp, Artificial sequence
  SiRNA target sequence
gtaacataaagtacttatcc

SEQ ID NO: 242227 - DNA, 20 bp, Artificial sequence
  SiRNA target sequence
taacataaagtacttatcca

SEQ ID NO: 242228 - DNA, 20 bp, Artificial sequence
  SiRNA target sequence
aacataaagtacttatccac

SEQ ID NO: 242229 - DNA, 20 bp, Artificial sequence
  SiRNA target sequence
acataaagtacttatccact

SEQ ID NO: 242230 - DNA, 20 bp, Artificial sequence
  SiRNA target sequence
cataaagtacttatccactc

SEQ ID NO: 242231 - DNA, 20 bp, Artificial sequence
  SiRNA target sequence
ataaagtacttatccactca

SEQ ID NO: 242232 - DNA, 20 bp, Artificial sequence
  SiRNA target sequence
taaagtacttatccactcac

SEQ ID NO: 242233 - DNA, 20 bp, Artificial sequence
  SiRNA target sequence
aaagtacttatccactcact

SEQ ID NO: 242234 - DNA, 20 bp, Artificial sequence
  SiRNA target sequence
aagtacttatccactcactg

SEQ ID NO: 242235 - DNA, 20 bp, Artificial sequence
  SiRNA target sequence
agtacttatccactcactgt

SEQ ID NO: 242236 - DNA, 20 bp, Artificial sequence
  SiRNA target sequence
gtacttatccactcactgta

SEQ ID NO: 242237 - DNA, 20 bp, Artificial sequence
  SiRNA target sequence
tacttatccactcactgtac

SEQ ID NO: 242238 - DNA, 20 bp, Artificial sequence
  SiRNA target sequence
acttatccactcactgtaca

SEQ ID NO: 242239 - DNA, 20 bp, Artificial sequence
  SiRNA target sequence
cttatccactcactgtacat

SEQ ID NO: 242240 - DNA, 20 bp, Artificial sequence
  SiRNA target sequence
ttatccactcactgtacata

SEQ ID NO: 242241 - DNA, 20 bp, Artificial sequence
  SiRNA target sequence
tatccactcactgtacatat

SEQ ID NO: 242242 - DNA, 20 bp, Artificial sequence
  SiRNA target sequence
atccactcactgtacatata

SEQ ID NO: 242243 - DNA, 20 bp, Artificial sequence
  SiRNA target sequence
tccactcactgtacatatat

SEQ ID NO: 242244 - DNA, 20 bp, Artificial sequence
  SiRNA target sequence
ccactcactgtacatatata

SEQ ID NO: 242245 - DNA, 20 bp, Artificial sequence
  SiRNA target sequence
cactcactgtacatatataa

SEQ ID NO: 242246 - DNA, 20 bp, Artificial sequence
  SiRNA target sequence
actcactgtacatatataaa

SEQ ID NO: 242247 - DNA, 20 bp, Artificial sequence
  SiRNA target sequence
ctcactgtacatatataaaa

SEQ ID NO: 242248 - DNA, 20 bp, Artificial sequence
  SiRNA target sequence
tcactgtacatatataaaaa

SEQ ID NO: 242249 - DNA, 20 bp, Artificial sequence
  SiRNA target sequence
cactgtacatatataaaaaa

SEQ ID NO: 242250 - DNA, 20 bp, Artificial sequence
  SiRNA target sequence
actgtacatatataaaaaag

SEQ ID NO: 242251 - DNA, 20 bp, Artificial sequence
  SiRNA target sequence
ctgtacatatataaaaaagg

SEQ ID NO: 242252 - DNA, 20 bp, Artificial sequence
  SiRNA target sequence
tgtacatatataaaaaagga

SEQ ID NO: 242253 - DNA, 20 bp, Artificial sequence
  SiRNA target sequence
gtacatatataaaaaaggag

SEQ ID NO: 242254 - DNA, 20 bp, Artificial sequence
  SiRNA target sequence
tacatatataaaaaaggaga

SEQ ID NO: 242255 - DNA, 20 bp, Artificial sequence
  SiRNA target sequence
acatatataaaaaaggagat

SEQ ID NO: 242256 - DNA, 20 bp, Artificial sequence
  SiRNA target sequence
catatataaaaaaggagata

SEQ ID NO: 242257 - DNA, 20 bp, Artificial sequence
  SiRNA target sequence
atatataaaaaaggagataa

SEQ ID NO: 242258 - DNA, 20 bp, Artificial sequence
  SiRNA target sequence
tatataaaaaaggagataag

SEQ ID NO: 242259 - DNA, 20 bp, Artificial sequence
  SiRNA target sequence
atataaaaaaggagataagc

SEQ ID NO: 242260 - DNA, 20 bp, Artificial sequence
  SiRNA target sequence
tataaaaaaggagataagcc

SEQ ID NO: 242261 - DNA, 20 bp, Artificial sequence
  SiRNA target sequence
ataaaaaaggagataagccc

SEQ ID NO: 242262 - DNA, 20 bp, Artificial sequence
  SiRNA target sequence
taaaaaaggagataagccca

SEQ ID NO: 242263 - DNA, 20 bp, Artificial sequence
  SiRNA target sequence
aaaaaaggagataagcccat

SEQ ID NO: 242264 - DNA, 20 bp, Artificial sequence
  SiRNA target sequence
aaaaaggagataagcccatc

SEQ ID NO: 242265 - DNA, 20 bp, Artificial sequence
  SiRNA target sequence
aaaaggagataagcccatca

SEQ ID NO: 242266 - DNA, 20 bp, Artificial sequence
  SiRNA target sequence
aaaggagataagcccatcaa

SEQ ID NO: 242267 - DNA, 20 bp, Artificial sequence
  SiRNA target sequence
aaggagataagcccatcaag

SEQ ID NO: 242268 - DNA, 20 bp, Artificial sequence
  SiRNA target sequence
aggagataagcccatcaagc

SEQ ID NO: 242269 - DNA, 20 bp, Artificial sequence
  SiRNA target sequence
ggagataagcccatcaagct

SEQ ID NO: 242270 - DNA, 20 bp, Artificial sequence
  SiRNA target sequence
gagataagcccatcaagctt

SEQ ID NO: 242271 - DNA, 20 bp, Artificial sequence
  SiRNA target sequence
agataagcccatcaagcttc

SEQ ID NO: 242272 - DNA, 20 bp, Artificial sequence
  SiRNA target sequence
gataagcccatcaagcttct

SEQ ID NO: 242273 - DNA, 20 bp, Artificial sequence
  SiRNA target sequence
ataagcccatcaagcttcta

SEQ ID NO: 242274 - DNA, 20 bp, Artificial sequence
  SiRNA target sequence
taagcccatcaagcttctaa

SEQ ID NO: 242275 - DNA, 20 bp, Artificial sequence
  SiRNA target sequence
aagcccatcaagcttctaac

SEQ ID NO: 242276 - DNA, 20 bp, Artificial sequence
  SiRNA target sequence
agcccatcaagcttctaact

SEQ ID NO: 242277 - DNA, 20 bp, Artificial sequence
  SiRNA target sequence
gcccatcaagcttctaactg

SEQ ID NO: 242278 - DNA, 20 bp, Artificial sequence
  SiRNA target sequence
cccatcaagcttctaactga

SEQ ID NO: 242279 - DNA, 20 bp, Artificial sequence
  SiRNA target sequence
ccatcaagcttctaactgac

SEQ ID NO: 242280 - DNA, 20 bp, Artificial sequence
  SiRNA target sequence
catcaagcttctaactgaca

SEQ ID NO: 242281 - DNA, 20 bp, Artificial sequence
  SiRNA target sequence
atcaagcttctaactgacat

SEQ ID NO: 242282 - DNA, 20 bp, Artificial sequence
  SiRNA target sequence
tcaagcttctaactgacatc

SEQ ID NO: 242283 - DNA, 20 bp, Artificial sequence
  SiRNA target sequence
caagcttctaactgacatct

SEQ ID NO: 242284 - DNA, 20 bp, Artificial sequence
  SiRNA target sequence
aagcttctaactgacatctt

SEQ ID NO: 242285 - DNA, 20 bp, Artificial sequence
  SiRNA target sequence
agcttctaactgacatctta

SEQ ID NO: 242286 - DNA, 20 bp, Artificial sequence
  SiRNA target sequence
gcttctaactgacatcttac

SEQ ID NO: 242287 - DNA, 20 bp, Artificial sequence
  SiRNA target sequence
cttctaactgacatcttacc

SEQ ID NO: 242288 - DNA, 20 bp, Artificial sequence
  SiRNA target sequence
ttctaactgacatcttacca

SEQ ID NO: 242289 - DNA, 20 bp, Artificial sequence
  SiRNA target sequence
tctaactgacatcttaccat

SEQ ID NO: 242290 - DNA, 20 bp, Artificial sequence
  SiRNA target sequence
ctaactgacatcttaccatc

SEQ ID NO: 242291 - DNA, 20 bp, Artificial sequence
  SiRNA target sequence
taactgacatcttaccatca

SEQ ID NO: 242292 - DNA, 20 bp, Artificial sequence
  SiRNA target sequence
aactgacatcttaccatcac

SEQ ID NO: 242293 - DNA, 20 bp, Artificial sequence
  SiRNA target sequence
actgacatcttaccatcaca

SEQ ID NO: 242294 - DNA, 20 bp, Artificial sequence
  SiRNA target sequence
ctgacatcttaccatcacaa

SEQ ID NO: 242295 - DNA, 20 bp, Artificial sequence
  SiRNA target sequence
tgacatcttaccatcacaaa

SEQ ID NO: 242296 - DNA, 20 bp, Artificial sequence
  SiRNA target sequence
gacatcttaccatcacaaaa

SEQ ID NO: 242297 - DNA, 20 bp, Artificial sequence
  SiRNA target sequence
acatcttaccatcacaaaaa

SEQ ID NO: 242298 - DNA, 20 bp, Artificial sequence
  SiRNA target sequence
catcttaccatcacaaaaaa

SEQ ID NO: 242299 - DNA, 20 bp, Artificial sequence
  SiRNA target sequence
atcttaccatcacaaaaaat

SEQ ID NO: 242300 - DNA, 20 bp, Artificial sequence
  SiRNA target sequence
tcttaccatcacaaaaaata

SEQ ID NO: 242301 - DNA, 20 bp, Artificial sequence
  SiRNA target sequence
cttaccatcacaaaaaatat

SEQ ID NO: 242302 - DNA, 20 bp, Artificial sequence
  SiRNA target sequence
ttaccatcacaaaaaatatc

SEQ ID NO: 242303 - DNA, 20 bp, Artificial sequence
  SiRNA target sequence
taccatcacaaaaaatatct

SEQ ID NO: 242304 - DNA, 20 bp, Artificial sequence
  SiRNA target sequence
accatcacaaaaaatatcta

SEQ ID NO: 242305 - DNA, 20 bp, Artificial sequence
  SiRNA target sequence
ccatcacaaaaaatatctag

SEQ ID NO: 242306 - DNA, 20 bp, Artificial sequence
  SiRNA target sequence
catcacaaaaaatatctagt

SEQ ID NO: 242307 - DNA, 20 bp, Artificial sequence
  SiRNA target sequence
atcacaaaaaatatctagtg

SEQ ID NO: 242308 - DNA, 20 bp, Artificial sequence
  SiRNA target sequence
tcacaaaaaatatctagtgc

SEQ ID NO: 242309 - DNA, 20 bp, Artificial sequence
  SiRNA target sequence
cacaaaaaatatctagtgcc

SEQ ID NO: 242310 - DNA, 20 bp, Artificial sequence
  SiRNA target sequence
acaaaaaatatctagtgccc

SEQ ID NO: 242311 - DNA, 20 bp, Artificial sequence
  SiRNA target sequence
caaaaaatatctagtgccca

SEQ ID NO: 242312 - DNA, 20 bp, Artificial sequence
  SiRNA target sequence
aaaaaatatctagtgcccat

SEQ ID NO: 242313 - DNA, 20 bp, Artificial sequence
  SiRNA target sequence
aaaaatatctagtgcccatt

SEQ ID NO: 242314 - DNA, 20 bp, Artificial sequence
  SiRNA target sequence
aaaatatctagtgcccattg

SEQ ID NO: 242315 - DNA, 20 bp, Artificial sequence
  SiRNA target sequence
aaatatctagtgcccattgt

SEQ ID NO: 242316 - DNA, 20 bp, Artificial sequence
  SiRNA target sequence
aatatctagtgcccattgtg

SEQ ID NO: 242317 - DNA, 20 bp, Artificial sequence
  SiRNA target sequence
atatctagtgcccattgtga

SEQ ID NO: 242318 - DNA, 20 bp, Artificial sequence
  SiRNA target sequence
tatctagtgcccattgtgat

SEQ ID NO: 242319 - DNA, 20 bp, Artificial sequence
  SiRNA target sequence
atctagtgcccattgtgatc

SEQ ID NO: 242320 - DNA, 20 bp, Artificial sequence
  SiRNA target sequence
tctagtgcccattgtgatcc

SEQ ID NO: 242321 - DNA, 20 bp, Artificial sequence
  SiRNA target sequence
ctagtgcccattgtgatcct

SEQ ID NO: 242322 - DNA, 20 bp, Artificial sequence
  SiRNA target sequence
tagtgcccattgtgatcctt

SEQ ID NO: 242323 - DNA, 20 bp, Artificial sequence
  SiRNA target sequence
agtgcccattgtgatccttt

SEQ ID NO: 242324 - DNA, 20 bp, Artificial sequence
  SiRNA target sequence
gtgcccattgtgatcctttt

SEQ ID NO: 242325 - DNA, 20 bp, Artificial sequence
  SiRNA target sequence
tgcccattgtgatccttttt

SEQ ID NO: 242326 - DNA, 20 bp, Artificial sequence
  SiRNA target sequence
gcccattgtgatcctttttg

SEQ ID NO: 242327 - DNA, 20 bp, Artificial sequence
  SiRNA target sequence
cccattgtgatcctttttgg

SEQ ID NO: 242328 - DNA, 20 bp, Artificial sequence
  SiRNA target sequence
ccattgtgatcctttttgga

SEQ ID NO: 242329 - DNA, 20 bp, Artificial sequence
  SiRNA target sequence
cattgtgatcctttttggat

SEQ ID NO: 242330 - DNA, 20 bp, Artificial sequence
  SiRNA target sequence
attgtgatcctttttggatt

SEQ ID NO: 242331 - DNA, 20 bp, Artificial sequence
  SiRNA target sequence
ttgtgatcctttttggattt

SEQ ID NO: 242332 - DNA, 20 bp, Artificial sequence
  SiRNA target sequence
tgtgatcctttttggatttt

SEQ ID NO: 242333 - DNA, 20 bp, Artificial sequence
  SiRNA target sequence
gtgatcctttttggatttta

SEQ ID NO: 242334 - DNA, 20 bp, Artificial sequence
  SiRNA target sequence
tgatcctttttggattttat

SEQ ID NO: 242335 - DNA, 20 bp, Artificial sequence
  SiRNA target sequence
gatcctttttggattttata

SEQ ID NO: 242336 - DNA, 20 bp, Artificial sequence
  SiRNA target sequence
atcctttttggattttatat

SEQ ID NO: 242337 - DNA, 20 bp, Artificial sequence
  SiRNA target sequence
tcctttttggattttatatt

SEQ ID NO: 242338 - DNA, 20 bp, Artificial sequence
  SiRNA target sequence
cctttttggattttatattc

SEQ ID NO: 242339 - DNA, 20 bp, Artificial sequence
  SiRNA target sequence
ctttttggattttatattca

SEQ ID NO: 242340 - DNA, 20 bp, Artificial sequence
  SiRNA target sequence
tttttggattttatattcaa

SEQ ID NO: 242341 - DNA, 20 bp, Artificial sequence
  SiRNA target sequence
ttttggattttatattcaaa

SEQ ID NO: 242342 - DNA, 20 bp, Artificial sequence
  SiRNA target sequence
tttggattttatattcaaat

SEQ ID NO: 242343 - DNA, 20 bp, Artificial sequence
  SiRNA target sequence
ttggattttatattcaaatg

SEQ ID NO: 242344 - DNA, 20 bp, Artificial sequence
  SiRNA target sequence
tggattttatattcaaatgg

SEQ ID NO: 242345 - DNA, 20 bp, Artificial sequence
  SiRNA target sequence
ggattttatattcaaatgga

SEQ ID NO: 242346 - DNA, 20 bp, Artificial sequence
  SiRNA target sequence
gattttatattcaaatggaa

SEQ ID NO: 242347 - DNA, 20 bp, Artificial sequence
  SiRNA target sequence
attttatattcaaatggaat

SEQ ID NO: 242348 - DNA, 20 bp, Artificial sequence
  SiRNA target sequence
ttttatattcaaatggaatt

SEQ ID NO: 242349 - DNA, 20 bp, Artificial sequence
  SiRNA target sequence
tttatattcaaatggaatta

SEQ ID NO: 242350 - DNA, 20 bp, Artificial sequence
  SiRNA target sequence
ttatattcaaatggaattaa

SEQ ID NO: 242351 - DNA, 20 bp, Artificial sequence
  SiRNA target sequence
tatattcaaatggaattaaa

SEQ ID NO: 242352 - DNA, 20 bp, Artificial sequence
  SiRNA target sequence
atattcaaatggaattaaaa

SEQ ID NO: 242353 - DNA, 20 bp, Artificial sequence
  SiRNA target sequence
tattcaaatggaattaaaag

SEQ ID NO: 242354 - DNA, 20 bp, Artificial sequence
  SiRNA target sequence
attcaaatggaattaaaaga

SEQ ID NO: 242355 - DNA, 20 bp, Artificial sequence
  SiRNA target sequence
ttcaaatggaattaaaagag

SEQ ID NO: 242356 - DNA, 20 bp, Artificial sequence
  SiRNA target sequence
tcaaatggaattaaaagaga

SEQ ID NO: 242357 - DNA, 20 bp, Artificial sequence
  SiRNA target sequence
caaatggaattaaaagagaa

SEQ ID NO: 242358 - DNA, 20 bp, Artificial sequence
  SiRNA target sequence
aaatggaattaaaagagaac

SEQ ID NO: 242359 - DNA, 20 bp, Artificial sequence
  SiRNA target sequence
aatggaattaaaagagaacc

SEQ ID NO: 242360 - DNA, 20 bp, Artificial sequence
  SiRNA target sequence
atggaattaaaagagaacca

SEQ ID NO: 242361 - DNA, 20 bp, Artificial sequence
  SiRNA target sequence
tggaattaaaagagaaccaa

SEQ ID NO: 242362 - DNA, 20 bp, Artificial sequence
  SiRNA target sequence
ggaattaaaagagaaccaat

SEQ ID NO: 242363 - DNA, 20 bp, Artificial sequence
  SiRNA target sequence
gaattaaaagagaaccaatt

SEQ ID NO: 242364 - DNA, 20 bp, Artificial sequence
  SiRNA target sequence
aattaaaagagaaccaatta

SEQ ID NO: 242365 - DNA, 20 bp, Artificial sequence
  SiRNA target sequence
attaaaagagaaccaattag

SEQ ID NO: 242366 - DNA, 20 bp, Artificial sequence
  SiRNA target sequence
ttaaaagagaaccaattaga

SEQ ID NO: 242367 - DNA, 20 bp, Artificial sequence
  SiRNA target sequence
taaaagagaaccaattagaa

SEQ ID NO: 242368 - DNA, 20 bp, Artificial sequence
  SiRNA target sequence
aaaagagaaccaattagaaa

SEQ ID NO: 242369 - DNA, 20 bp, Artificial sequence
  SiRNA target sequence
aaagagaaccaattagaaaa

SEQ ID NO: 242370 - DNA, 20 bp, Artificial sequence
  SiRNA target sequence
aagagaaccaattagaaaaa

SEQ ID NO: 242371 - DNA, 20 bp, Artificial sequence
  SiRNA target sequence
agagaaccaattagaaaaaa

SEQ ID NO: 242372 - DNA, 20 bp, Artificial sequence
  SiRNA target sequence
gagaaccaattagaaaaaaa

SEQ ID NO: 242373 - DNA, 20 bp, Artificial sequence
  SiRNA target sequence
agaaccaattagaaaaaaaa

SEQ ID NO: 242374 - DNA, 20 bp, Artificial sequence
  SiRNA target sequence
gaaccaattagaaaaaaaat

SEQ ID NO: 242375 - DNA, 20 bp, Artificial sequence
  SiRNA target sequence
aaccaattagaaaaaaaatg

SEQ ID NO: 242376 - DNA, 20 bp, Artificial sequence
  SiRNA target sequence
accaattagaaaaaaaatgc

SEQ ID NO: 242377 - DNA, 20 bp, Artificial sequence
  SiRNA target sequence
ccaattagaaaaaaaatgcc

SEQ ID NO: 242378 - DNA, 20 bp, Artificial sequence
  SiRNA target sequence
caattagaaaaaaaatgcca

SEQ ID NO: 242379 - DNA, 20 bp, Artificial sequence
  SiRNA target sequence
aattagaaaaaaaatgccaa

SEQ ID NO: 242380 - DNA, 20 bp, Artificial sequence
  SiRNA target sequence
attagaaaaaaaatgccaat

SEQ ID NO: 242381 - DNA, 20 bp, Artificial sequence
  SiRNA target sequence
ttagaaaaaaaatgccaata

SEQ ID NO: 242382 - DNA, 20 bp, Artificial sequence
  SiRNA target sequence
tagaaaaaaaatgccaataa

SEQ ID NO: 242383 - DNA, 20 bp, Artificial sequence
  SiRNA target sequence
agaaaaaaaatgccaataaa

SEQ ID NO: 242384 - DNA, 20 bp, Artificial sequence
  SiRNA target sequence
gaaaaaaaatgccaataaaa

SEQ ID NO: 242385 - DNA, 20 bp, Artificial sequence
  SiRNA target sequence
aaaaaaaatgccaataaaac

SEQ ID NO: 242386 - DNA, 20 bp, Artificial sequence
  SiRNA target sequence
aaaaaaatgccaataaaacc

SEQ ID NO: 242387 - DNA, 20 bp, Artificial sequence
  SiRNA target sequence
aaaaaatgccaataaaacca

SEQ ID NO: 242388 - DNA, 20 bp, Artificial sequence
  SiRNA target sequence
aaaaatgccaataaaaccaa

SEQ ID NO: 242389 - DNA, 20 bp, Artificial sequence
  SiRNA target sequence
aaaatgccaataaaaccaaa

SEQ ID NO: 242390 - DNA, 20 bp, Artificial sequence
  SiRNA target sequence
aaatgccaataaaaccaaaa

SEQ ID NO: 242391 - DNA, 20 bp, Artificial sequence
  SiRNA target sequence
aatgccaataaaaccaaaaa

SEQ ID NO: 242392 - DNA, 20 bp, Artificial sequence
  SiRNA target sequence
atgccaataaaaccaaaaat

SEQ ID NO: 242393 - DNA, 20 bp, Artificial sequence
  SiRNA target sequence
tgccaataaaaccaaaaata

SEQ ID NO: 242394 - DNA, 20 bp, Artificial sequence
  SiRNA target sequence
gccaataaaaccaaaaataa

SEQ ID NO: 242395 - DNA, 20 bp, Artificial sequence
  SiRNA target sequence
ccaataaaaccaaaaataat

SEQ ID NO: 242396 - DNA, 20 bp, Artificial sequence
  SiRNA target sequence
caataaaaccaaaaataata

SEQ ID NO: 242397 - DNA, 20 bp, Artificial sequence
  SiRNA target sequence
aataaaaccaaaaataataa

SEQ ID NO: 242398 - DNA, 20 bp, Artificial sequence
  SiRNA target sequence
ataaaaccaaaaataataaa

SEQ ID NO: 242399 - DNA, 20 bp, Artificial sequence
  SiRNA target sequence
taaaaccaaaaataataaaa

SEQ ID NO: 242400 - DNA, 20 bp, Artificial sequence
  SiRNA target sequence
aaaaccaaaaataataaaat

SEQ ID NO: 242401 - DNA, 20 bp, Artificial sequence
  SiRNA target sequence
aaaccaaaaataataaaatt

SEQ ID NO: 242402 - DNA, 20 bp, Artificial sequence
  SiRNA target sequence
aaccaaaaataataaaattc

SEQ ID NO: 242403 - DNA, 20 bp, Artificial sequence
  SiRNA target sequence
accaaaaataataaaattca

SEQ ID NO: 242404 - DNA, 20 bp, Artificial sequence
  SiRNA target sequence
ccaaaaataataaaattcac

SEQ ID NO: 242405 - DNA, 20 bp, Artificial sequence
  SiRNA target sequence
caaaaataataaaattcaca

SEQ ID NO: 242406 - DNA, 20 bp, Artificial sequence
  SiRNA target sequence
aaaaataataaaattcacaa

SEQ ID NO: 242407 - DNA, 20 bp, Artificial sequence
  SiRNA target sequence
aaaataataaaattcacaat

SEQ ID NO: 242408 - DNA, 20 bp, Artificial sequence
  SiRNA target sequence
aaataataaaattcacaata

SEQ ID NO: 242409 - DNA, 20 bp, Artificial sequence
  SiRNA target sequence
aataataaaattcacaatac

SEQ ID NO: 242410 - DNA, 20 bp, Artificial sequence
  SiRNA target sequence
ataataaaattcacaatact

SEQ ID NO: 242411 - DNA, 20 bp, Artificial sequence
  SiRNA target sequence
taataaaattcacaatacta

SEQ ID NO: 242412 - DNA, 20 bp, Artificial sequence
  SiRNA target sequence
aataaaattcacaatactaa

SEQ ID NO: 242413 - DNA, 20 bp, Artificial sequence
  SiRNA target sequence
ataaaattcacaatactaag

SEQ ID NO: 242414 - DNA, 20 bp, Artificial sequence
  SiRNA target sequence
taaaattcacaatactaaga

SEQ ID NO: 242415 - DNA, 20 bp, Artificial sequence
  SiRNA target sequence
aaaattcacaatactaagaa

SEQ ID NO: 242416 - DNA, 20 bp, Artificial sequence
  SiRNA target sequence
aaattcacaatactaagaat

SEQ ID NO: 242417 - DNA, 20 bp, Artificial sequence
  SiRNA target sequence
aattcacaatactaagaata

SEQ ID NO: 242418 - DNA, 20 bp, Artificial sequence
  SiRNA target sequence
attcacaatactaagaatag

SEQ ID NO: 242419 - DNA, 20 bp, Artificial sequence
  SiRNA target sequence
ttcacaatactaagaataga

SEQ ID NO: 242420 - DNA, 20 bp, Artificial sequence
  SiRNA target sequence
tcacaatactaagaatagag

SEQ ID NO: 242421 - DNA, 20 bp, Artificial sequence
  SiRNA target sequence
cacaatactaagaatagagt

SEQ ID NO: 242422 - DNA, 20 bp, Artificial sequence
  SiRNA target sequence
acaatactaagaatagagta

SEQ ID NO: 242423 - DNA, 20 bp, Artificial sequence
  SiRNA target sequence
caatactaagaatagagtac

SEQ ID NO: 242424 - DNA, 20 bp, Artificial sequence
  SiRNA target sequence
aatactaagaatagagtaca

SEQ ID NO: 242425 - DNA, 20 bp, Artificial sequence
  SiRNA target sequence
atactaagaatagagtacac

SEQ ID NO: 242426 - DNA, 20 bp, Artificial sequence
  SiRNA target sequence
tactaagaatagagtacaca

SEQ ID NO: 242427 - DNA, 20 bp, Artificial sequence
  SiRNA target sequence
actaagaatagagtacacat

SEQ ID NO: 242428 - DNA, 20 bp, Artificial sequence
  SiRNA target sequence
ctaagaatagagtacacatt

SEQ ID NO: 242429 - DNA, 20 bp, Artificial sequence
  SiRNA target sequence
taagaatagagtacacattt

SEQ ID NO: 242430 - DNA, 20 bp, Artificial sequence
  SiRNA target sequence
aagaatagagtacacattta

SEQ ID NO: 242431 - DNA, 20 bp, Artificial sequence
  SiRNA target sequence
agaatagagtacacatttaa

SEQ ID NO: 242432 - DNA, 20 bp, Artificial sequence
  SiRNA target sequence
gaatagagtacacatttaaa

SEQ ID NO: 242433 - DNA, 20 bp, Artificial sequence
  SiRNA target sequence
aatagagtacacatttaaag

SEQ ID NO: 242434 - DNA, 20 bp, Artificial sequence
  SiRNA target sequence
atagagtacacatttaaagc

SEQ ID NO: 242435 - DNA, 20 bp, Artificial sequence
  SiRNA target sequence
tagagtacacatttaaagcc

SEQ ID NO: 242436 - DNA, 20 bp, Artificial sequence
  SiRNA target sequence
agagtacacatttaaagcct

SEQ ID NO: 242437 - DNA, 20 bp, Artificial sequence
  SiRNA target sequence
gagtacacatttaaagcctt

SEQ ID NO: 242438 - DNA, 20 bp, Artificial sequence
  SiRNA target sequence
agtacacatttaaagccttt

SEQ ID NO: 242439 - DNA, 20 bp, Artificial sequence
  SiRNA target sequence
gtacacatttaaagcctttt

SEQ ID NO: 242440 - DNA, 20 bp, Artificial sequence
  SiRNA target sequence
tacacatttaaagccttttg

SEQ ID NO: 242441 - DNA, 20 bp, Artificial sequence
  SiRNA target sequence
acacatttaaagccttttgg

SEQ ID NO: 242442 - DNA, 20 bp, Artificial sequence
  SiRNA target sequence
cacatttaaagccttttgga

SEQ ID NO: 242443 - DNA, 20 bp, Artificial sequence
  SiRNA target sequence
acatttaaagccttttggac

SEQ ID NO: 242444 - DNA, 20 bp, Artificial sequence
  SiRNA target sequence
catttaaagccttttggaca

SEQ ID NO: 242445 - DNA, 20 bp, Artificial sequence
  SiRNA target sequence
atttaaagccttttggacat

SEQ ID NO: 242446 - DNA, 20 bp, Artificial sequence
  SiRNA target sequence
tttaaagccttttggacata

SEQ ID NO: 242447 - DNA, 20 bp, Artificial sequence
  SiRNA target sequence
ttaaagccttttggacatat

SEQ ID NO: 242448 - DNA, 20 bp, Artificial sequence
  SiRNA target sequence
taaagccttttggacatatg

SEQ ID NO: 242449 - DNA, 20 bp, Artificial sequence
  SiRNA target sequence
aaagccttttggacatatga

SEQ ID NO: 242450 - DNA, 20 bp, Artificial sequence
  SiRNA target sequence
aagccttttggacatatgac

SEQ ID NO: 242451 - DNA, 20 bp, Artificial sequence
  SiRNA target sequence
agccttttggacatatgaca

SEQ ID NO: 242452 - DNA, 20 bp, Artificial sequence
  SiRNA target sequence
gccttttggacatatgacat

SEQ ID NO: 242453 - DNA, 20 bp, Artificial sequence
  SiRNA target sequence
ccttttggacatatgacatc

SEQ ID NO: 242454 - DNA, 20 bp, Artificial sequence
  SiRNA target sequence
cttttggacatatgacatca

SEQ ID NO: 242455 - DNA, 20 bp, Artificial sequence
  SiRNA target sequence
ttttggacatatgacatcat

SEQ ID NO: 242456 - DNA, 20 bp, Artificial sequence
  SiRNA target sequence
tttggacatatgacatcata

SEQ ID NO: 242457 - DNA, 20 bp, Artificial sequence
  SiRNA target sequence
ttggacatatgacatcataa

SEQ ID NO: 242458 - DNA, 20 bp, Artificial sequence
  SiRNA target sequence
tggacatatgacatcataag

SEQ ID NO: 242459 - DNA, 20 bp, Artificial sequence
  SiRNA target sequence
ggacatatgacatcataaga

SEQ ID NO: 242460 - DNA, 20 bp, Artificial sequence
  SiRNA target sequence
gacatatgacatcataagac

SEQ ID NO: 242461 - DNA, 20 bp, Artificial sequence
  SiRNA target sequence
acatatgacatcataagaca

SEQ ID NO: 242462 - DNA, 20 bp, Artificial sequence
  SiRNA target sequence
catatgacatcataagacat

SEQ ID NO: 242463 - DNA, 20 bp, Artificial sequence
  SiRNA target sequence
atatgacatcataagacata

SEQ ID NO: 242464 - DNA, 20 bp, Artificial sequence
  SiRNA target sequence
tatgacatcataagacatat

SEQ ID NO: 242465 - DNA, 20 bp, Artificial sequence
  SiRNA target sequence
atgacatcataagacatata

SEQ ID NO: 242466 - DNA, 20 bp, Artificial sequence
  SiRNA target sequence
tgacatcataagacatataa

SEQ ID NO: 242467 - DNA, 20 bp, Artificial sequence
  SiRNA target sequence
gacatcataagacatataat

SEQ ID NO: 242468 - DNA, 20 bp, Artificial sequence
  SiRNA target sequence
acatcataagacatataatt

SEQ ID NO: 242469 - DNA, 20 bp, Artificial sequence
  SiRNA target sequence
catcataagacatataattg

SEQ ID NO: 242470 - DNA, 20 bp, Artificial sequence
  SiRNA target sequence
atcataagacatataattgg

SEQ ID NO: 242471 - DNA, 20 bp, Artificial sequence
  SiRNA target sequence
tcataagacatataattggc

SEQ ID NO: 242472 - DNA, 20 bp, Artificial sequence
  SiRNA target sequence
cataagacatataattggca

SEQ ID NO: 242473 - DNA, 20 bp, Artificial sequence
  SiRNA target sequence
ataagacatataattggcag

SEQ ID NO: 242474 - DNA, 20 bp, Artificial sequence
  SiRNA target sequence
taagacatataattggcagt

SEQ ID NO: 242475 - DNA, 20 bp, Artificial sequence
  SiRNA target sequence
aagacatataattggcagtg

SEQ ID NO: 242476 - DNA, 20 bp, Artificial sequence
  SiRNA target sequence
agacatataattggcagtga

SEQ ID NO: 242477 - DNA, 20 bp, Artificial sequence
  SiRNA target sequence
gacatataattggcagtgaa

SEQ ID NO: 242478 - DNA, 20 bp, Artificial sequence
  SiRNA target sequence
acatataattggcagtgaaa

SEQ ID NO: 242479 - DNA, 20 bp, Artificial sequence
  SiRNA target sequence
catataattggcagtgaaaa

SEQ ID NO: 242480 - DNA, 20 bp, Artificial sequence
  SiRNA target sequence
atataattggcagtgaaaag

SEQ ID NO: 242481 - DNA, 20 bp, Artificial sequence
  SiRNA target sequence
tataattggcagtgaaaaga

SEQ ID NO: 242482 - DNA, 20 bp, Artificial sequence
  SiRNA target sequence
ataattggcagtgaaaagaa

SEQ ID NO: 242483 - DNA, 20 bp, Artificial sequence
  SiRNA target sequence
taattggcagtgaaaagaaa

SEQ ID NO: 242484 - DNA, 20 bp, Artificial sequence
  SiRNA target sequence
aattggcagtgaaaagaaaa

SEQ ID NO: 242485 - DNA, 20 bp, Artificial sequence
  SiRNA target sequence
attggcagtgaaaagaaaag

SEQ ID NO: 242486 - DNA, 20 bp, Artificial sequence
  SiRNA target sequence
ttggcagtgaaaagaaaagc

SEQ ID NO: 242487 - DNA, 20 bp, Artificial sequence
  SiRNA target sequence
tggcagtgaaaagaaaagct

SEQ ID NO: 242488 - DNA, 20 bp, Artificial sequence
  SiRNA target sequence
ggcagtgaaaagaaaagctt

SEQ ID NO: 242489 - DNA, 20 bp, Artificial sequence
  SiRNA target sequence
gcagtgaaaagaaaagcttt

SEQ ID NO: 242490 - DNA, 20 bp, Artificial sequence
  SiRNA target sequence
cagtgaaaagaaaagcttta

SEQ ID NO: 242491 - DNA, 20 bp, Artificial sequence
  SiRNA target sequence
agtgaaaagaaaagctttat

SEQ ID NO: 242492 - DNA, 20 bp, Artificial sequence
  SiRNA target sequence
gtgaaaagaaaagctttatg

SEQ ID NO: 242493 - DNA, 20 bp, Artificial sequence
  SiRNA target sequence
tgaaaagaaaagctttatgt

SEQ ID NO: 242494 - DNA, 20 bp, Artificial sequence
  SiRNA target sequence
gaaaagaaaagctttatgta

SEQ ID NO: 242495 - DNA, 20 bp, Artificial sequence
  SiRNA target sequence
aaaagaaaagctttatgtag

SEQ ID NO: 242496 - DNA, 20 bp, Artificial sequence
  SiRNA target sequence
aaagaaaagctttatgtagt

SEQ ID NO: 242497 - DNA, 20 bp, Artificial sequence
  SiRNA target sequence
aagaaaagctttatgtagta

SEQ ID NO: 242498 - DNA, 20 bp, Artificial sequence
  SiRNA target sequence
agaaaagctttatgtagtac

SEQ ID NO: 242499 - DNA, 20 bp, Artificial sequence
  SiRNA target sequence
gaaaagctttatgtagtaca

SEQ ID NO: 242500 - DNA, 20 bp, Artificial sequence
  SiRNA target sequence
aaaagctttatgtagtacag

SEQ ID NO: 242501 - DNA, 20 bp, Artificial sequence
  SiRNA target sequence
aaagctttatgtagtacagt

SEQ ID NO: 242502 - DNA, 20 bp, Artificial sequence
  SiRNA target sequence
aagctttatgtagtacagtg

SEQ ID NO: 242503 - DNA, 20 bp, Artificial sequence
  SiRNA target sequence
agctttatgtagtacagtga

SEQ ID NO: 242504 - DNA, 20 bp, Artificial sequence
  SiRNA target sequence
gctttatgtagtacagtgac

SEQ ID NO: 242505 - DNA, 20 bp, Artificial sequence
  SiRNA target sequence
ctttatgtagtacagtgacg

SEQ ID NO: 242506 - DNA, 20 bp, Artificial sequence
  SiRNA target sequence
tttatgtagtacagtgacga

SEQ ID NO: 242507 - DNA, 20 bp, Artificial sequence
  SiRNA target sequence
ttatgtagtacagtgacgaa

SEQ ID NO: 242508 - DNA, 20 bp, Artificial sequence
  SiRNA target sequence
tatgtagtacagtgacgaag

SEQ ID NO: 242509 - DNA, 20 bp, Artificial sequence
  SiRNA target sequence
atgtagtacagtgacgaagg

SEQ ID NO: 242510 - DNA, 20 bp, Artificial sequence
  SiRNA target sequence
tgtagtacagtgacgaagga

SEQ ID NO: 242511 - DNA, 20 bp, Artificial sequence
  SiRNA target sequence
gtagtacagtgacgaaggaa

SEQ ID NO: 242512 - DNA, 20 bp, Artificial sequence
  SiRNA target sequence
tagtacagtgacgaaggaat

SEQ ID NO: 242513 - DNA, 20 bp, Artificial sequence
  SiRNA target sequence
agtacagtgacgaaggaatt

SEQ ID NO: 242514 - DNA, 20 bp, Artificial sequence
  SiRNA target sequence
gtacagtgacgaaggaattt

SEQ ID NO: 242515 - DNA, 20 bp, Artificial sequence
  SiRNA target sequence
tacagtgacgaaggaatttg

SEQ ID NO: 242516 - DNA, 20 bp, Artificial sequence
  SiRNA target sequence
acagtgacgaaggaatttgt

SEQ ID NO: 242517 - DNA, 20 bp, Artificial sequence
  SiRNA target sequence
cagtgacgaaggaatttgtt

SEQ ID NO: 242518 - DNA, 20 bp, Artificial sequence
  SiRNA target sequence
agtgacgaaggaatttgttt

SEQ ID NO: 242519 - DNA, 20 bp, Artificial sequence
  SiRNA target sequence
gtgacgaaggaatttgtttt

SEQ ID NO: 242520 - DNA, 20 bp, Artificial sequence
  SiRNA target sequence
tgacgaaggaatttgttttg

SEQ ID NO: 242521 - DNA, 20 bp, Artificial sequence
  SiRNA target sequence
gacgaaggaatttgttttgt

SEQ ID NO: 242522 - DNA, 20 bp, Artificial sequence
  SiRNA target sequence
acgaaggaatttgttttgtc

SEQ ID NO: 242523 - DNA, 20 bp, Artificial sequence
  SiRNA target sequence
cgaaggaatttgttttgtca

SEQ ID NO: 242524 - DNA, 20 bp, Artificial sequence
  SiRNA target sequence
gaaggaatttgttttgtcat

SEQ ID NO: 242525 - DNA, 20 bp, Artificial sequence
  SiRNA target sequence
aaggaatttgttttgtcata

SEQ ID NO: 242526 - DNA, 20 bp, Artificial sequence
  SiRNA target sequence
aggaatttgttttgtcataa

SEQ ID NO: 242527 - DNA, 20 bp, Artificial sequence
  SiRNA target sequence
ggaatttgttttgtcataat

SEQ ID NO: 242528 - DNA, 20 bp, Artificial sequence
  SiRNA target sequence
gaatttgttttgtcataatc

SEQ ID NO: 242529 - DNA, 20 bp, Artificial sequence
  SiRNA target sequence
aatttgttttgtcataatca

SEQ ID NO: 242530 - DNA, 20 bp, Artificial sequence
  SiRNA target sequence
atttgttttgtcataatcac

SEQ ID NO: 242531 - DNA, 20 bp, Artificial sequence
  SiRNA target sequence
tttgttttgtcataatcacg

SEQ ID NO: 242532 - DNA, 20 bp, Artificial sequence
  SiRNA target sequence
ttgttttgtcataatcacga

SEQ ID NO: 242533 - DNA, 20 bp, Artificial sequence
  SiRNA target sequence
tgttttgtcataatcacgat

SEQ ID NO: 242534 - DNA, 20 bp, Artificial sequence
  SiRNA target sequence
gttttgtcataatcacgatt

SEQ ID NO: 242535 - DNA, 20 bp, Artificial sequence
  SiRNA target sequence
ttttgtcataatcacgattt

SEQ ID NO: 242536 - DNA, 20 bp, Artificial sequence
  SiRNA target sequence
tttgtcataatcacgatttc

SEQ ID NO: 242537 - DNA, 20 bp, Artificial sequence
  SiRNA target sequence
ttgtcataatcacgatttct

SEQ ID NO: 242538 - DNA, 20 bp, Artificial sequence
  SiRNA target sequence
tgtcataatcacgatttctc

SEQ ID NO: 242539 - DNA, 20 bp, Artificial sequence
  SiRNA target sequence
gtcataatcacgatttctct

SEQ ID NO: 242540 - DNA, 20 bp, Artificial sequence
  SiRNA target sequence
tcataatcacgatttctctg

SEQ ID NO: 242541 - DNA, 20 bp, Artificial sequence
  SiRNA target sequence
cataatcacgatttctctgt

SEQ ID NO: 242542 - DNA, 20 bp, Artificial sequence
  SiRNA target sequence
ataatcacgatttctctgta

SEQ ID NO: 242543 - DNA, 20 bp, Artificial sequence
  SiRNA target sequence
taatcacgatttctctgtaa

SEQ ID NO: 242544 - DNA, 20 bp, Artificial sequence
  SiRNA target sequence
aatcacgatttctctgtaaa

SEQ ID NO: 242545 - DNA, 20 bp, Artificial sequence
  SiRNA target sequence
atcacgatttctctgtaaaa

SEQ ID NO: 242546 - DNA, 20 bp, Artificial sequence
  SiRNA target sequence
tcacgatttctctgtaaaat

SEQ ID NO: 242547 - DNA, 20 bp, Artificial sequence
  SiRNA target sequence
cacgatttctctgtaaaatt

SEQ ID NO: 242548 - DNA, 20 bp, Artificial sequence
  SiRNA target sequence
acgatttctctgtaaaattc

SEQ ID NO: 242549 - DNA, 20 bp, Artificial sequence
  SiRNA target sequence
cgatttctctgtaaaattcc

SEQ ID NO: 242550 - DNA, 20 bp, Artificial sequence
  SiRNA target sequence
gatttctctgtaaaattcca

SEQ ID NO: 242551 - DNA, 20 bp, Artificial sequence
  SiRNA target sequence
atttctctgtaaaattccaa

SEQ ID NO: 242552 - DNA, 20 bp, Artificial sequence
  SiRNA target sequence
tttctctgtaaaattccaat

SEQ ID NO: 242553 - DNA, 20 bp, Artificial sequence
  SiRNA target sequence
ttctctgtaaaattccaata

SEQ ID NO: 242554 - DNA, 20 bp, Artificial sequence
  SiRNA target sequence
tctctgtaaaattccaataa

SEQ ID NO: 242555 - DNA, 20 bp, Artificial sequence
  SiRNA target sequence
ctctgtaaaattccaataat

SEQ ID NO: 242556 - DNA, 20 bp, Artificial sequence
  SiRNA target sequence
tctgtaaaattccaataatg

SEQ ID NO: 242557 - DNA, 20 bp, Artificial sequence
  SiRNA target sequence
ctgtaaaattccaataatgt

SEQ ID NO: 242558 - DNA, 20 bp, Artificial sequence
  SiRNA target sequence
tgtaaaattccaataatgtg

SEQ ID NO: 242559 - DNA, 20 bp, Artificial sequence
  SiRNA target sequence
gtaaaattccaataatgtgt

SEQ ID NO: 242560 - DNA, 20 bp, Artificial sequence
  SiRNA target sequence
taaaattccaataatgtgtt

SEQ ID NO: 242561 - DNA, 20 bp, Artificial sequence
  SiRNA target sequence
aaaattccaataatgtgtta

SEQ ID NO: 242562 - DNA, 20 bp, Artificial sequence
  SiRNA target sequence
aaattccaataatgtgttaa

SEQ ID NO: 242563 - DNA, 20 bp, Artificial sequence
  SiRNA target sequence
aattccaataatgtgttaat

SEQ ID NO: 242564 - DNA, 20 bp, Artificial sequence
  SiRNA target sequence
attccaataatgtgttaatc

SEQ ID NO: 242565 - DNA, 20 bp, Artificial sequence
  SiRNA target sequence
ttccaataatgtgttaatca

SEQ ID NO: 242566 - DNA, 20 bp, Artificial sequence
  SiRNA target sequence
tccaataatgtgttaatcac

SEQ ID NO: 242567 - DNA, 20 bp, Artificial sequence
  SiRNA target sequence
ccaataatgtgttaatcaca

SEQ ID NO: 242568 - DNA, 20 bp, Artificial sequence
  SiRNA target sequence
caataatgtgttaatcacac

SEQ ID NO: 242569 - DNA, 20 bp, Artificial sequence
  SiRNA target sequence
aataatgtgttaatcacaca

SEQ ID NO: 242570 - DNA, 20 bp, Artificial sequence
  SiRNA target sequence
ataatgtgttaatcacacat

SEQ ID NO: 242571 - DNA, 20 bp, Artificial sequence
  SiRNA target sequence
taatgtgttaatcacacatg

SEQ ID NO: 242572 - DNA, 20 bp, Artificial sequence
  SiRNA target sequence
aatgtgttaatcacacatgc

SEQ ID NO: 242573 - DNA, 20 bp, Artificial sequence
  SiRNA target sequence
atgtgttaatcacacatgcc

SEQ ID NO: 242574 - DNA, 20 bp, Artificial sequence
  SiRNA target sequence
tgtgttaatcacacatgcca

SEQ ID NO: 242575 - DNA, 20 bp, Artificial sequence
  SiRNA target sequence
gtgttaatcacacatgccat

SEQ ID NO: 242576 - DNA, 20 bp, Artificial sequence
  SiRNA target sequence
tgttaatcacacatgccatt

SEQ ID NO: 242577 - DNA, 20 bp, Artificial sequence
  SiRNA target sequence
gttaatcacacatgccatta

SEQ ID NO: 242578 - DNA, 20 bp, Artificial sequence
  SiRNA target sequence
ttaatcacacatgccattaa

SEQ ID NO: 242579 - DNA, 20 bp, Artificial sequence
  SiRNA target sequence
taatcacacatgccattaaa

SEQ ID NO: 242580 - DNA, 20 bp, Artificial sequence
  SiRNA target sequence
aatcacacatgccattaaaa

SEQ ID NO: 242581 - DNA, 20 bp, Artificial sequence
  SiRNA target sequence
atcacacatgccattaaaaa

SEQ ID NO: 242582 - DNA, 20 bp, Artificial sequence
  SiRNA target sequence
tcacacatgccattaaaaat

SEQ ID NO: 242583 - DNA, 20 bp, Artificial sequence
  SiRNA target sequence
cacacatgccattaaaaatg

SEQ ID NO: 242584 - DNA, 20 bp, Artificial sequence
  SiRNA target sequence
acacatgccattaaaaatgt

SEQ ID NO: 242585 - DNA, 20 bp, Artificial sequence
  SiRNA target sequence
cacatgccattaaaaatgta

SEQ ID NO: 242586 - DNA, 20 bp, Artificial sequence
  SiRNA target sequence
acatgccattaaaaatgtaa

SEQ ID NO: 242587 - DNA, 20 bp, Artificial sequence
  SiRNA target sequence
catgccattaaaaatgtaag

SEQ ID NO: 242588 - DNA, 20 bp, Artificial sequence
  SiRNA target sequence
atgccattaaaaatgtaagt

SEQ ID NO: 242589 - DNA, 20 bp, Artificial sequence
  SiRNA target sequence
tgccattaaaaatgtaagtg

SEQ ID NO: 242590 - DNA, 20 bp, Artificial sequence
  SiRNA target sequence
gccattaaaaatgtaagtga

SEQ ID NO: 242591 - DNA, 20 bp, Artificial sequence
  SiRNA target sequence
ccattaaaaatgtaagtgac

SEQ ID NO: 242592 - DNA, 20 bp, Artificial sequence
  SiRNA target sequence
cattaaaaatgtaagtgaca

SEQ ID NO: 242593 - DNA, 20 bp, Artificial sequence
  SiRNA target sequence
attaaaaatgtaagtgacaa

SEQ ID NO: 242594 - DNA, 20 bp, Artificial sequence
  SiRNA target sequence
ttaaaaatgtaagtgacaat

SEQ ID NO: 242595 - DNA, 20 bp, Artificial sequence
  SiRNA target sequence
taaaaatgtaagtgacaata

SEQ ID NO: 242596 - DNA, 20 bp, Artificial sequence
  SiRNA target sequence
aaaaatgtaagtgacaataa

SEQ ID NO: 242597 - DNA, 20 bp, Artificial sequence
  SiRNA target sequence
aaaatgtaagtgacaataat

SEQ ID NO: 242598 - DNA, 20 bp, Artificial sequence
  SiRNA target sequence
aaatgtaagtgacaataata

SEQ ID NO: 242599 - DNA, 20 bp, Artificial sequence
  SiRNA target sequence
aatgtaagtgacaataatat

SEQ ID NO: 242600 - DNA, 20 bp, Artificial sequence
  SiRNA target sequence
atgtaagtgacaataatatt

SEQ ID NO: 242601 - DNA, 20 bp, Artificial sequence
  SiRNA target sequence
tgtaagtgacaataatattt

SEQ ID NO: 242602 - DNA, 20 bp, Artificial sequence
  SiRNA target sequence
gtaagtgacaataatatttt

SEQ ID NO: 242603 - DNA, 20 bp, Artificial sequence
  SiRNA target sequence
taagtgacaataatattttt

SEQ ID NO: 242604 - DNA, 20 bp, Artificial sequence
  SiRNA target sequence
aagtgacaataatattttta

SEQ ID NO: 242605 - DNA, 20 bp, Artificial sequence
  SiRNA target sequence
agtgacaataatatttttac

SEQ ID NO: 242606 - DNA, 20 bp, Artificial sequence
  SiRNA target sequence
gtgacaataatatttttact

SEQ ID NO: 242607 - DNA, 20 bp, Artificial sequence
  SiRNA target sequence
tgacaataatatttttactt

SEQ ID NO: 242608 - DNA, 20 bp, Artificial sequence
  SiRNA target sequence
gacaataatatttttacttt

SEQ ID NO: 242609 - DNA, 20 bp, Artificial sequence
  SiRNA target sequence
acaataatatttttactttt

SEQ ID NO: 242610 - DNA, 20 bp, Artificial sequence
  SiRNA target sequence
caataatatttttacttttg

SEQ ID NO: 242611 - DNA, 20 bp, Artificial sequence
  SiRNA target sequence
aataatatttttacttttgg

SEQ ID NO: 242612 - DNA, 20 bp, Artificial sequence
  SiRNA target sequence
ataatatttttacttttggg

SEQ ID NO: 242613 - DNA, 20 bp, Artificial sequence
  SiRNA target sequence
taatatttttacttttggga

SEQ ID NO: 242614 - DNA, 20 bp, Artificial sequence
  SiRNA target sequence
aatatttttacttttgggaa

SEQ ID NO: 242615 - DNA, 20 bp, Artificial sequence
  SiRNA target sequence
atatttttacttttgggaat

SEQ ID NO: 242616 - DNA, 20 bp, Artificial sequence
  SiRNA target sequence
tatttttacttttgggaatt

SEQ ID NO: 242617 - DNA, 20 bp, Artificial sequence
  SiRNA target sequence
atttttacttttgggaattt

SEQ ID NO: 242618 - DNA, 20 bp, Artificial sequence
  SiRNA target sequence
tttttacttttgggaatttt

SEQ ID NO: 242619 - DNA, 20 bp, Artificial sequence
  SiRNA target sequence
ttttacttttgggaattttt

SEQ ID NO: 242620 - DNA, 20 bp, Artificial sequence
  SiRNA target sequence
tttacttttgggaatttttt

SEQ ID NO: 242621 - DNA, 20 bp, Artificial sequence
  SiRNA target sequence
ttacttttgggaattttttt

SEQ ID NO: 242622 - DNA, 20 bp, Artificial sequence
  SiRNA target sequence
tacttttgggaatttttttg

SEQ ID NO: 242623 - DNA, 20 bp, Artificial sequence
  SiRNA target sequence
acttttgggaatttttttgt

SEQ ID NO: 242624 - DNA, 20 bp, Artificial sequence
  SiRNA target sequence
cttttgggaatttttttgtc

SEQ ID NO: 242625 - DNA, 20 bp, Artificial sequence
  SiRNA target sequence
ttttgggaatttttttgtct

SEQ ID NO: 242626 - DNA, 20 bp, Artificial sequence
  SiRNA target sequence
tttgggaatttttttgtctt

SEQ ID NO: 242627 - DNA, 20 bp, Artificial sequence
  SiRNA target sequence
ttgggaatttttttgtctta

SEQ ID NO: 242628 - DNA, 20 bp, Artificial sequence
  SiRNA target sequence
tgggaatttttttgtcttag

SEQ ID NO: 242629 - DNA, 20 bp, Artificial sequence
  SiRNA target sequence
gggaatttttttgtcttagt

SEQ ID NO: 242630 - DNA, 20 bp, Artificial sequence
  SiRNA target sequence
ggaatttttttgtcttagtc

SEQ ID NO: 242631 - DNA, 20 bp, Artificial sequence
  SiRNA target sequence
gaatttttttgtcttagtca

SEQ ID NO: 242632 - DNA, 20 bp, Artificial sequence
  SiRNA target sequence
aatttttttgtcttagtcat

SEQ ID NO: 242633 - DNA, 21 bp, Artificial sequence
  SiRNA target sequence
ttaattaaaatcaacatctat

SEQ ID NO: 242634 - DNA, 21 bp, Artificial sequence
  SiRNA target sequence
taattaaaatcaacatctatc

SEQ ID NO: 242635 - DNA, 21 bp, Artificial sequence
  SiRNA target sequence
aattaaaatcaacatctatct

SEQ ID NO: 242636 - DNA, 21 bp, Artificial sequence
  SiRNA target sequence
attaaaatcaacatctatctc

SEQ ID NO: 242637 - DNA, 21 bp, Artificial sequence
  SiRNA target sequence
ttaaaatcaacatctatctca

SEQ ID NO: 242638 - DNA, 21 bp, Artificial sequence
  SiRNA target sequence
taaaatcaacatctatctcag

SEQ ID NO: 242639 - DNA, 21 bp, Artificial sequence
  SiRNA target sequence
aaaatcaacatctatctcaga

SEQ ID NO: 242640 - DNA, 21 bp, Artificial sequence
  SiRNA target sequence
aaatcaacatctatctcagaa

SEQ ID NO: 242641 - DNA, 21 bp, Artificial sequence
  SiRNA target sequence
aatcaacatctatctcagaat

SEQ ID NO: 242642 - DNA, 21 bp, Artificial sequence
  SiRNA target sequence
atcaacatctatctcagaatt

SEQ ID NO: 242643 - DNA, 21 bp, Artificial sequence
  SiRNA target sequence
tcaacatctatctcagaattt

SEQ ID NO: 242644 - DNA, 21 bp, Artificial sequence
  SiRNA target sequence
caacatctatctcagaatttt

SEQ ID NO: 242645 - DNA, 21 bp, Artificial sequence
  SiRNA target sequence
aacatctatctcagaattttg

SEQ ID NO: 242646 - DNA, 21 bp, Artificial sequence
  SiRNA target sequence
acatctatctcagaattttgt

SEQ ID NO: 242647 - DNA, 21 bp, Artificial sequence
  SiRNA target sequence
catctatctcagaattttgtt

SEQ ID NO: 242648 - DNA, 21 bp, Artificial sequence
  SiRNA target sequence
atctatctcagaattttgttc

SEQ ID NO: 242649 - DNA, 21 bp, Artificial sequence
  SiRNA target sequence
tctatctcagaattttgttca

SEQ ID NO: 242650 - DNA, 21 bp, Artificial sequence
  SiRNA target sequence
ctatctcagaattttgttcaa

SEQ ID NO: 242651 - DNA, 21 bp, Artificial sequence
  SiRNA target sequence
tatctcagaattttgttcaat

SEQ ID NO: 242652 - DNA, 21 bp, Artificial sequence
  SiRNA target sequence
atctcagaattttgttcaatt

SEQ ID NO: 242653 - DNA, 21 bp, Artificial sequence
  SiRNA target sequence
tctcagaattttgttcaattg

SEQ ID NO: 242654 - DNA, 21 bp, Artificial sequence
  SiRNA target sequence
ctcagaattttgttcaattga

SEQ ID NO: 242655 - DNA, 21 bp, Artificial sequence
  SiRNA target sequence
tcagaattttgttcaattgat

SEQ ID NO: 242656 - DNA, 21 bp, Artificial sequence
  SiRNA target sequence
cagaattttgttcaattgatt

SEQ ID NO: 242657 - DNA, 21 bp, Artificial sequence
  SiRNA target sequence
agaattttgttcaattgattc

SEQ ID NO: 242658 - DNA, 21 bp, Artificial sequence
  SiRNA target sequence
gaattttgttcaattgattca

SEQ ID NO: 242659 - DNA, 21 bp, Artificial sequence
  SiRNA target sequence
aattttgttcaattgattcat

SEQ ID NO: 242660 - DNA, 21 bp, Artificial sequence
  SiRNA target sequence
attttgttcaattgattcatt

SEQ ID NO: 242661 - DNA, 21 bp, Artificial sequence
  SiRNA target sequence
ttttgttcaattgattcatta

SEQ ID NO: 242662 - DNA, 21 bp, Artificial sequence
  SiRNA target sequence
tttgttcaattgattcattat

SEQ ID NO: 242663 - DNA, 21 bp, Artificial sequence
  SiRNA target sequence
ttgttcaattgattcattata

SEQ ID NO: 242664 - DNA, 21 bp, Artificial sequence
  SiRNA target sequence
tgttcaattgattcattatat

SEQ ID NO: 242665 - DNA, 21 bp, Artificial sequence
  SiRNA target sequence
gttcaattgattcattatatt

SEQ ID NO: 242666 - DNA, 21 bp, Artificial sequence
  SiRNA target sequence
ttcaattgattcattatattt

SEQ ID NO: 242667 - DNA, 21 bp, Artificial sequence
  SiRNA target sequence
tcaattgattcattatatttt

SEQ ID NO: 242668 - DNA, 21 bp, Artificial sequence
  SiRNA target sequence
caattgattcattatattttt

SEQ ID NO: 242669 - DNA, 21 bp, Artificial sequence
  SiRNA target sequence
aattgattcattatatttttt

SEQ ID NO: 242670 - DNA, 21 bp, Artificial sequence
  SiRNA target sequence
attgattcattatatttttta

SEQ ID NO: 242671 - DNA, 21 bp, Artificial sequence
  SiRNA target sequence
ttgattcattatattttttac

SEQ ID NO: 242672 - DNA, 21 bp, Artificial sequence
  SiRNA target sequence
tgattcattatattttttact

SEQ ID NO: 242673 - DNA, 21 bp, Artificial sequence
  SiRNA target sequence
gattcattatattttttactt

SEQ ID NO: 242674 - DNA, 21 bp, Artificial sequence
  SiRNA target sequence
attcattatattttttactta

SEQ ID NO: 242675 - DNA, 21 bp, Artificial sequence
  SiRNA target sequence
ttcattatattttttacttaa

SEQ ID NO: 242676 - DNA, 21 bp, Artificial sequence
  SiRNA target sequence
tcattatattttttacttaaa

SEQ ID NO: 242677 - DNA, 21 bp, Artificial sequence
  SiRNA target sequence
cattatattttttacttaaat

SEQ ID NO: 242678 - DNA, 21 bp, Artificial sequence
  SiRNA target sequence
attatattttttacttaaata

SEQ ID NO: 242679 - DNA, 21 bp, Artificial sequence
  SiRNA target sequence
ttatattttttacttaaataa

SEQ ID NO: 242680 - DNA, 21 bp, Artificial sequence
  SiRNA target sequence
tatattttttacttaaataac

SEQ ID NO: 242681 - DNA, 21 bp, Artificial sequence
  SiRNA target sequence
atattttttacttaaataaca

SEQ ID NO: 242682 - DNA, 21 bp, Artificial sequence
  SiRNA target sequence
tattttttacttaaataacag

SEQ ID NO: 242683 - DNA, 21 bp, Artificial sequence
  SiRNA target sequence
attttttacttaaataacaga

SEQ ID NO: 242684 - DNA, 21 bp, Artificial sequence
  SiRNA target sequence
ttttttacttaaataacagac

SEQ ID NO: 242685 - DNA, 21 bp, Artificial sequence
  SiRNA target sequence
tttttacttaaataacagaca

SEQ ID NO: 242686 - DNA, 21 bp, Artificial sequence
  SiRNA target sequence
ttttacttaaataacagacac

SEQ ID NO: 242687 - DNA, 21 bp, Artificial sequence
  SiRNA target sequence
tttacttaaataacagacact

SEQ ID NO: 242688 - DNA, 21 bp, Artificial sequence
  SiRNA target sequence
ttacttaaataacagacactc

SEQ ID NO: 242689 - DNA, 21 bp, Artificial sequence
  SiRNA target sequence
tacttaaataacagacactcc

SEQ ID NO: 242690 - DNA, 21 bp, Artificial sequence
  SiRNA target sequence
acttaaataacagacactcct

SEQ ID NO: 242691 - DNA, 21 bp, Artificial sequence
  SiRNA target sequence
cttaaataacagacactcctg

SEQ ID NO: 242692 - DNA, 21 bp, Artificial sequence
  SiRNA target sequence
ttaaataacagacactcctga

SEQ ID NO: 242693 - DNA, 21 bp, Artificial sequence
  SiRNA target sequence
taaataacagacactcctgat

SEQ ID NO: 242694 - DNA, 21 bp, Artificial sequence
  SiRNA target sequence
aaataacagacactcctgatc

SEQ ID NO: 242695 - DNA, 21 bp, Artificial sequence
  SiRNA target sequence
aataacagacactcctgatcc

SEQ ID NO: 242696 - DNA, 21 bp, Artificial sequence
  SiRNA target sequence
ataacagacactcctgatcca

SEQ ID NO: 242697 - DNA, 21 bp, Artificial sequence
  SiRNA target sequence
taacagacactcctgatccac

SEQ ID NO: 242698 - DNA, 21 bp, Artificial sequence
  SiRNA target sequence
aacagacactcctgatccaca

SEQ ID NO: 242699 - DNA, 21 bp, Artificial sequence
  SiRNA target sequence
acagacactcctgatccacaa

SEQ ID NO: 242700 - DNA, 21 bp, Artificial sequence
  SiRNA target sequence
cagacactcctgatccacaaa

SEQ ID NO: 242701 - DNA, 21 bp, Artificial sequence
  SiRNA target sequence
agacactcctgatccacaaaa

SEQ ID NO: 242702 - DNA, 21 bp, Artificial sequence
  SiRNA target sequence
gacactcctgatccacaaaaa

SEQ ID NO: 242703 - DNA, 21 bp, Artificial sequence
  SiRNA target sequence
acactcctgatccacaaaaaa

SEQ ID NO: 242704 - DNA, 21 bp, Artificial sequence
  SiRNA target sequence
cactcctgatccacaaaaaat

SEQ ID NO: 242705 - DNA, 21 bp, Artificial sequence
  SiRNA target sequence
actcctgatccacaaaaaatt

SEQ ID NO: 242706 - DNA, 21 bp, Artificial sequence
  SiRNA target sequence
ctcctgatccacaaaaaattt

SEQ ID NO: 242707 - DNA, 21 bp, Artificial sequence
  SiRNA target sequence
tcctgatccacaaaaaatttg

SEQ ID NO: 242708 - DNA, 21 bp, Artificial sequence
  SiRNA target sequence
cctgatccacaaaaaatttgc

SEQ ID NO: 242709 - DNA, 21 bp, Artificial sequence
  SiRNA target sequence
ctgatccacaaaaaatttgca

SEQ ID NO: 242710 - DNA, 21 bp, Artificial sequence
  SiRNA target sequence
tgatccacaaaaaatttgcaa

SEQ ID NO: 242711 - DNA, 21 bp, Artificial sequence
  SiRNA target sequence
gatccacaaaaaatttgcaaa

SEQ ID NO: 242712 - DNA, 21 bp, Artificial sequence
  SiRNA target sequence
atccacaaaaaatttgcaaat

SEQ ID NO: 242713 - DNA, 21 bp, Artificial sequence
  SiRNA target sequence
tccacaaaaaatttgcaaata

SEQ ID NO: 242714 - DNA, 21 bp, Artificial sequence
  SiRNA target sequence
ccacaaaaaatttgcaaatat

SEQ ID NO: 242715 - DNA, 21 bp, Artificial sequence
  SiRNA target sequence
cacaaaaaatttgcaaatatt

SEQ ID NO: 242716 - DNA, 21 bp, Artificial sequence
  SiRNA target sequence
acaaaaaatttgcaaatatta

SEQ ID NO: 242717 - DNA, 21 bp, Artificial sequence
  SiRNA target sequence
caaaaaatttgcaaatattaa

SEQ ID NO: 242718 - DNA, 21 bp, Artificial sequence
  SiRNA target sequence
aaaaaatttgcaaatattaaa

SEQ ID NO: 242719 - DNA, 21 bp, Artificial sequence
  SiRNA target sequence
aaaaatttgcaaatattaaaa

SEQ ID NO: 242720 - DNA, 21 bp, Artificial sequence
  SiRNA target sequence
aaaatttgcaaatattaaaaa

SEQ ID NO: 242721 - DNA, 21 bp, Artificial sequence
  SiRNA target sequence
aaatttgcaaatattaaaaat

SEQ ID NO: 242722 - DNA, 21 bp, Artificial sequence
  SiRNA target sequence
aatttgcaaatattaaaaata

SEQ ID NO: 242723 - DNA, 21 bp, Artificial sequence
  SiRNA target sequence
atttgcaaatattaaaaatat

SEQ ID NO: 242724 - DNA, 21 bp, Artificial sequence
  SiRNA target sequence
tttgcaaatattaaaaatata

SEQ ID NO: 242725 - DNA, 21 bp, Artificial sequence
  SiRNA target sequence
ttgcaaatattaaaaatataa

SEQ ID NO: 242726 - DNA, 21 bp, Artificial sequence
  SiRNA target sequence
tgcaaatattaaaaatataaa

SEQ ID NO: 242727 - DNA, 21 bp, Artificial sequence
  SiRNA target sequence
gcaaatattaaaaatataaaa

SEQ ID NO: 242728 - DNA, 21 bp, Artificial sequence
  SiRNA target sequence
caaatattaaaaatataaaag

SEQ ID NO: 242729 - DNA, 21 bp, Artificial sequence
  SiRNA target sequence
aaatattaaaaatataaaaga

SEQ ID NO: 242730 - DNA, 21 bp, Artificial sequence
  SiRNA target sequence
aatattaaaaatataaaagac

SEQ ID NO: 242731 - DNA, 21 bp, Artificial sequence
  SiRNA target sequence
atattaaaaatataaaagaca

SEQ ID NO: 242732 - DNA, 21 bp, Artificial sequence
  SiRNA target sequence
tattaaaaatataaaagacac

SEQ ID NO: 242733 - DNA, 21 bp, Artificial sequence
  SiRNA target sequence
attaaaaatataaaagacacg

SEQ ID NO: 242734 - DNA, 21 bp, Artificial sequence
  SiRNA target sequence
ttaaaaatataaaagacacgt

SEQ ID NO: 242735 - DNA, 21 bp, Artificial sequence
  SiRNA target sequence
taaaaatataaaagacacgta

SEQ ID NO: 242736 - DNA, 21 bp, Artificial sequence
  SiRNA target sequence
aaaaatataaaagacacgtat

SEQ ID NO: 242737 - DNA, 21 bp, Artificial sequence
  SiRNA target sequence
aaaatataaaagacacgtatg

SEQ ID NO: 242738 - DNA, 21 bp, Artificial sequence
  SiRNA target sequence
aaatataaaagacacgtatga

SEQ ID NO: 242739 - DNA, 21 bp, Artificial sequence
  SiRNA target sequence
aatataaaagacacgtatgat

SEQ ID NO: 242740 - DNA, 21 bp, Artificial sequence
  SiRNA target sequence
atataaaagacacgtatgata

SEQ ID NO: 242741 - DNA, 21 bp, Artificial sequence
  SiRNA target sequence
tataaaagacacgtatgatac

SEQ ID NO: 242742 - DNA, 21 bp, Artificial sequence
  SiRNA target sequence
ataaaagacacgtatgatact

SEQ ID NO: 242743 - DNA, 21 bp, Artificial sequence
  SiRNA target sequence
taaaagacacgtatgatactt

SEQ ID NO: 242744 - DNA, 21 bp, Artificial sequence
  SiRNA target sequence
aaaagacacgtatgatacttg

SEQ ID NO: 242745 - DNA, 21 bp, Artificial sequence
  SiRNA target sequence
aaagacacgtatgatacttgt

SEQ ID NO: 242746 - DNA, 21 bp, Artificial sequence
  SiRNA target sequence
aagacacgtatgatacttgtc

SEQ ID NO: 242747 - DNA, 21 bp, Artificial sequence
  SiRNA target sequence
agacacgtatgatacttgtct

SEQ ID NO: 242748 - DNA, 21 bp, Artificial sequence
  SiRNA target sequence
gacacgtatgatacttgtcta

SEQ ID NO: 242749 - DNA, 21 bp, Artificial sequence
  SiRNA target sequence
acacgtatgatacttgtctaa

SEQ ID NO: 242750 - DNA, 21 bp, Artificial sequence
  SiRNA target sequence
cacgtatgatacttgtctaat

SEQ ID NO: 242751 - DNA, 21 bp, Artificial sequence
  SiRNA target sequence
acgtatgatacttgtctaata

SEQ ID NO: 242752 - DNA, 21 bp, Artificial sequence
  SiRNA target sequence
cgtatgatacttgtctaatat

SEQ ID NO: 242753 - DNA, 21 bp, Artificial sequence
  SiRNA target sequence
gtatgatacttgtctaatatc

SEQ ID NO: 242754 - DNA, 21 bp, Artificial sequence
  SiRNA target sequence
tatgatacttgtctaatatct

SEQ ID NO: 242755 - DNA, 21 bp, Artificial sequence
  SiRNA target sequence
atgatacttgtctaatatctg

SEQ ID NO: 242756 - DNA, 21 bp, Artificial sequence
  SiRNA target sequence
tgatacttgtctaatatctgg

SEQ ID NO: 242757 - DNA, 21 bp, Artificial sequence
  SiRNA target sequence
gatacttgtctaatatctgga

SEQ ID NO: 242758 - DNA, 21 bp, Artificial sequence
  SiRNA target sequence
atacttgtctaatatctggaa

SEQ ID NO: 242759 - DNA, 21 bp, Artificial sequence
  SiRNA target sequence
tacttgtctaatatctggaat

SEQ ID NO: 242760 - DNA, 21 bp, Artificial sequence
  SiRNA target sequence
acttgtctaatatctggaatt

SEQ ID NO: 242761 - DNA, 21 bp, Artificial sequence
  SiRNA target sequence
cttgtctaatatctggaattt

SEQ ID NO: 242762 - DNA, 21 bp, Artificial sequence
  SiRNA target sequence
ttgtctaatatctggaatttc

SEQ ID NO: 242763 - DNA, 21 bp, Artificial sequence
  SiRNA target sequence
tgtctaatatctggaatttct

SEQ ID NO: 242764 - DNA, 21 bp, Artificial sequence
  SiRNA target sequence
gtctaatatctggaatttcta

SEQ ID NO: 242765 - DNA, 21 bp, Artificial sequence
  SiRNA target sequence
tctaatatctggaatttctat

SEQ ID NO: 242766 - DNA, 21 bp, Artificial sequence
  SiRNA target sequence
ctaatatctggaatttctata

SEQ ID NO: 242767 - DNA, 21 bp, Artificial sequence
  SiRNA target sequence
taatatctggaatttctataa

SEQ ID NO: 242768 - DNA, 21 bp, Artificial sequence
  SiRNA target sequence
aatatctggaatttctataaa

SEQ ID NO: 242769 - DNA, 21 bp, Artificial sequence
  SiRNA target sequence
atatctggaatttctataaac

SEQ ID NO: 242770 - DNA, 21 bp, Artificial sequence
  SiRNA target sequence
tatctggaatttctataaacg

SEQ ID NO: 242771 - DNA, 21 bp, Artificial sequence
  SiRNA target sequence
atctggaatttctataaacgt

SEQ ID NO: 242772 - DNA, 21 bp, Artificial sequence
  SiRNA target sequence
tctggaatttctataaacgtc

SEQ ID NO: 242773 - DNA, 21 bp, Artificial sequence
  SiRNA target sequence
ctggaatttctataaacgtca

SEQ ID NO: 242774 - DNA, 21 bp, Artificial sequence
  SiRNA target sequence
tggaatttctataaacgtcaa

SEQ ID NO: 242775 - DNA, 21 bp, Artificial sequence
  SiRNA target sequence
ggaatttctataaacgtcaaa

SEQ ID NO: 242776 - DNA, 21 bp, Artificial sequence
  SiRNA target sequence
gaatttctataaacgtcaaaa

SEQ ID NO: 242777 - DNA, 21 bp, Artificial sequence
  SiRNA target sequence
aatttctataaacgtcaaaaa

SEQ ID NO: 242778 - DNA, 21 bp, Artificial sequence
  SiRNA target sequence
atttctataaacgtcaaaaaa

SEQ ID NO: 242779 - DNA, 21 bp, Artificial sequence
  SiRNA target sequence
tttctataaacgtcaaaaaag

SEQ ID NO: 242780 - DNA, 21 bp, Artificial sequence
  SiRNA target sequence
ttctataaacgtcaaaaaagt

SEQ ID NO: 242781 - DNA, 21 bp, Artificial sequence
  SiRNA target sequence
tctataaacgtcaaaaaagtt

SEQ ID NO: 242782 - DNA, 21 bp, Artificial sequence
  SiRNA target sequence
ctataaacgtcaaaaaagttc

SEQ ID NO: 242783 - DNA, 21 bp, Artificial sequence
  SiRNA target sequence
tataaacgtcaaaaaagttcc

SEQ ID NO: 242784 - DNA, 21 bp, Artificial sequence
  SiRNA target sequence
ataaacgtcaaaaaagttcca

SEQ ID NO: 242785 - DNA, 21 bp, Artificial sequence
  SiRNA target sequence
taaacgtcaaaaaagttccat

SEQ ID NO: 242786 - DNA, 21 bp, Artificial sequence
  SiRNA target sequence
aaacgtcaaaaaagttccata

SEQ ID NO: 242787 - DNA, 21 bp, Artificial sequence
  SiRNA target sequence
aacgtcaaaaaagttccatat

SEQ ID NO: 242788 - DNA, 21 bp, Artificial sequence
  SiRNA target sequence
acgtcaaaaaagttccatata

SEQ ID NO: 242789 - DNA, 21 bp, Artificial sequence
  SiRNA target sequence
cgtcaaaaaagttccatataa

SEQ ID NO: 242790 - DNA, 21 bp, Artificial sequence
  SiRNA target sequence
gtcaaaaaagttccatataaa

SEQ ID NO: 242791 - DNA, 21 bp, Artificial sequence
  SiRNA target sequence
tcaaaaaagttccatataaag

SEQ ID NO: 242792 - DNA, 21 bp, Artificial sequence
  SiRNA target sequence
caaaaaagttccatataaaga

SEQ ID NO: 242793 - DNA, 21 bp, Artificial sequence
  SiRNA target sequence
aaaaaagttccatataaagag

SEQ ID NO: 242794 - DNA, 21 bp, Artificial sequence
  SiRNA target sequence
aaaaagttccatataaagaga

SEQ ID NO: 242795 - DNA, 21 bp, Artificial sequence
  SiRNA target sequence
aaaagttccatataaagagat

SEQ ID NO: 242796 - DNA, 21 bp, Artificial sequence
  SiRNA target sequence
aaagttccatataaagagata

SEQ ID NO: 242797 - DNA, 21 bp, Artificial sequence
  SiRNA target sequence
aagttccatataaagagataa

SEQ ID NO: 242798 - DNA, 21 bp, Artificial sequence
  SiRNA target sequence
agttccatataaagagataat

SEQ ID NO: 242799 - DNA, 21 bp, Artificial sequence
  SiRNA target sequence
gttccatataaagagataata

SEQ ID NO: 242800 - DNA, 21 bp, Artificial sequence
  SiRNA target sequence
ttccatataaagagataatag

SEQ ID NO: 242801 - DNA, 21 bp, Artificial sequence
  SiRNA target sequence
tccatataaagagataataga

SEQ ID NO: 242802 - DNA, 21 bp, Artificial sequence
  SiRNA target sequence
ccatataaagagataatagat

SEQ ID NO: 242803 - DNA, 21 bp, Artificial sequence
  SiRNA target sequence
catataaagagataatagatt

SEQ ID NO: 242804 - DNA, 21 bp, Artificial sequence
  SiRNA target sequence
atataaagagataatagattt

SEQ ID NO: 242805 - DNA, 21 bp, Artificial sequence
  SiRNA target sequence
tataaagagataatagattta

SEQ ID NO: 242806 - DNA, 21 bp, Artificial sequence
  SiRNA target sequence
ataaagagataatagatttac

SEQ ID NO: 242807 - DNA, 21 bp, Artificial sequence
  SiRNA target sequence
taaagagataatagatttacc

SEQ ID NO: 242808 - DNA, 21 bp, Artificial sequence
  SiRNA target sequence
aaagagataatagatttacca

SEQ ID NO: 242809 - DNA, 21 bp, Artificial sequence
  SiRNA target sequence
aagagataatagatttaccaa

SEQ ID NO: 242810 - DNA, 21 bp, Artificial sequence
  SiRNA target sequence
agagataatagatttaccaat

SEQ ID NO: 242811 - DNA, 21 bp, Artificial sequence
  SiRNA target sequence
gagataatagatttaccaatt

SEQ ID NO: 242812 - DNA, 21 bp, Artificial sequence
  SiRNA target sequence
agataatagatttaccaattt

SEQ ID NO: 242813 - DNA, 21 bp, Artificial sequence
  SiRNA target sequence
gataatagatttaccaatttt

SEQ ID NO: 242814 - DNA, 21 bp, Artificial sequence
  SiRNA target sequence
ataatagatttaccaattttg

SEQ ID NO: 242815 - DNA, 21 bp, Artificial sequence
  SiRNA target sequence
taatagatttaccaattttga

SEQ ID NO: 242816 - DNA, 21 bp, Artificial sequence
  SiRNA target sequence
aatagatttaccaattttgat

SEQ ID NO: 242817 - DNA, 21 bp, Artificial sequence
  SiRNA target sequence
atagatttaccaattttgata

SEQ ID NO: 242818 - DNA, 21 bp, Artificial sequence
  SiRNA target sequence
tagatttaccaattttgatac

SEQ ID NO: 242819 - DNA, 21 bp, Artificial sequence
  SiRNA target sequence
agatttaccaattttgataca

SEQ ID NO: 242820 - DNA, 21 bp, Artificial sequence
  SiRNA target sequence
gatttaccaattttgatacat

SEQ ID NO: 242821 - DNA, 21 bp, Artificial sequence
  SiRNA target sequence
atttaccaattttgatacata

SEQ ID NO: 242822 - DNA, 21 bp, Artificial sequence
  SiRNA target sequence
tttaccaattttgatacatac

SEQ ID NO: 242823 - DNA, 21 bp, Artificial sequence
  SiRNA target sequence
ttaccaattttgatacataca

SEQ ID NO: 242824 - DNA, 21 bp, Artificial sequence
  SiRNA target sequence
taccaattttgatacatacac

SEQ ID NO: 242825 - DNA, 21 bp, Artificial sequence
  SiRNA target sequence
accaattttgatacatacacc

SEQ ID NO: 242826 - DNA, 21 bp, Artificial sequence
  SiRNA target sequence
ccaattttgatacatacacca

SEQ ID NO: 242827 - DNA, 21 bp, Artificial sequence
  SiRNA target sequence
caattttgatacatacaccat

SEQ ID NO: 242828 - DNA, 21 bp, Artificial sequence
  SiRNA target sequence
aattttgatacatacaccatc

SEQ ID NO: 242829 - DNA, 21 bp, Artificial sequence
  SiRNA target sequence
attttgatacatacaccatca

SEQ ID NO: 242830 - DNA, 21 bp, Artificial sequence
  SiRNA target sequence
ttttgatacatacaccatcat

SEQ ID NO: 242831 - DNA, 21 bp, Artificial sequence
  SiRNA target sequence
tttgatacatacaccatcata

SEQ ID NO: 242832 - DNA, 21 bp, Artificial sequence
  SiRNA target sequence
ttgatacatacaccatcataa

SEQ ID NO: 242833 - DNA, 21 bp, Artificial sequence
  SiRNA target sequence
tgatacatacaccatcataaa

SEQ ID NO: 242834 - DNA, 21 bp, Artificial sequence
  SiRNA target sequence
gatacatacaccatcataaaa

SEQ ID NO: 242835 - DNA, 21 bp, Artificial sequence
  SiRNA target sequence
atacatacaccatcataaaaa

SEQ ID NO: 242836 - DNA, 21 bp, Artificial sequence
  SiRNA target sequence
tacatacaccatcataaaaac

SEQ ID NO: 242837 - DNA, 21 bp, Artificial sequence
  SiRNA target sequence
acatacaccatcataaaaact

SEQ ID NO: 242838 - DNA, 21 bp, Artificial sequence
  SiRNA target sequence
catacaccatcataaaaactt

SEQ ID NO: 242839 - DNA, 21 bp, Artificial sequence
  SiRNA target sequence
atacaccatcataaaaacttt

SEQ ID NO: 242840 - DNA, 21 bp, Artificial sequence
  SiRNA target sequence
tacaccatcataaaaactttt

SEQ ID NO: 242841 - DNA, 21 bp, Artificial sequence
  SiRNA target sequence
acaccatcataaaaactttta

SEQ ID NO: 242842 - DNA, 21 bp, Artificial sequence
  SiRNA target sequence
caccatcataaaaacttttaa

SEQ ID NO: 242843 - DNA, 21 bp, Artificial sequence
  SiRNA target sequence
accatcataaaaacttttaaa

SEQ ID NO: 242844 - DNA, 21 bp, Artificial sequence
  SiRNA target sequence
ccatcataaaaacttttaaat

SEQ ID NO: 242845 - DNA, 21 bp, Artificial sequence
  SiRNA target sequence
catcataaaaacttttaaatt

SEQ ID NO: 242846 - DNA, 21 bp, Artificial sequence
  SiRNA target sequence
atcataaaaacttttaaattt

SEQ ID NO: 242847 - DNA, 21 bp, Artificial sequence
  SiRNA target sequence
tcataaaaacttttaaattta

SEQ ID NO: 242848 - DNA, 21 bp, Artificial sequence
  SiRNA target sequence
cataaaaacttttaaatttat

SEQ ID NO: 242849 - DNA, 21 bp, Artificial sequence
  SiRNA target sequence
ataaaaacttttaaatttata

SEQ ID NO: 242850 - DNA, 21 bp, Artificial sequence
  SiRNA target sequence
taaaaacttttaaatttatac

SEQ ID NO: 242851 - DNA, 21 bp, Artificial sequence
  SiRNA target sequence
aaaaacttttaaatttatacc

SEQ ID NO: 242852 - DNA, 21 bp, Artificial sequence
  SiRNA target sequence
aaaacttttaaatttatacct

SEQ ID NO: 242853 - DNA, 21 bp, Artificial sequence
  SiRNA target sequence
aaacttttaaatttatacctg

SEQ ID NO: 242854 - DNA, 21 bp, Artificial sequence
  SiRNA target sequence
aacttttaaatttatacctgt

SEQ ID NO: 242855 - DNA, 21 bp, Artificial sequence
  SiRNA target sequence
acttttaaatttatacctgta

SEQ ID NO: 242856 - DNA, 21 bp, Artificial sequence
  SiRNA target sequence
cttttaaatttatacctgtat

SEQ ID NO: 242857 - DNA, 21 bp, Artificial sequence
  SiRNA target sequence
ttttaaatttatacctgtatt

SEQ ID NO: 242858 - DNA, 21 bp, Artificial sequence
  SiRNA target sequence
tttaaatttatacctgtattt

SEQ ID NO: 242859 - DNA, 21 bp, Artificial sequence
  SiRNA target sequence
ttaaatttatacctgtattta

SEQ ID NO: 242860 - DNA, 21 bp, Artificial sequence
  SiRNA target sequence
taaatttatacctgtatttaa

SEQ ID NO: 242861 - DNA, 21 bp, Artificial sequence
  SiRNA target sequence
aaatttatacctgtatttaac

SEQ ID NO: 242862 - DNA, 21 bp, Artificial sequence
  SiRNA target sequence
aatttatacctgtatttaaca

SEQ ID NO: 242863 - DNA, 21 bp, Artificial sequence
  SiRNA target sequence
atttatacctgtatttaacag

SEQ ID NO: 242864 - DNA, 21 bp, Artificial sequence
  SiRNA target sequence
tttatacctgtatttaacagg

SEQ ID NO: 242865 - DNA, 21 bp, Artificial sequence
  SiRNA target sequence
ttatacctgtatttaacaggc

SEQ ID NO: 242866 - DNA, 21 bp, Artificial sequence
  SiRNA target sequence
tatacctgtatttaacaggca

SEQ ID NO: 242867 - DNA, 21 bp, Artificial sequence
  SiRNA target sequence
atacctgtatttaacaggcac

SEQ ID NO: 242868 - DNA, 21 bp, Artificial sequence
  SiRNA target sequence
tacctgtatttaacaggcacc

SEQ ID NO: 242869 - DNA, 21 bp, Artificial sequence
  SiRNA target sequence
acctgtatttaacaggcaccc

SEQ ID NO: 242870 - DNA, 21 bp, Artificial sequence
  SiRNA target sequence
cctgtatttaacaggcaccct

SEQ ID NO: 242871 - DNA, 21 bp, Artificial sequence
  SiRNA target sequence
ctgtatttaacaggcaccctc

SEQ ID NO: 242872 - DNA, 21 bp, Artificial sequence
  SiRNA target sequence
tgtatttaacaggcaccctca

SEQ ID NO: 242873 - DNA, 21 bp, Artificial sequence
  SiRNA target sequence
gtatttaacaggcaccctcat

SEQ ID NO: 242874 - DNA, 21 bp, Artificial sequence
  SiRNA target sequence
tatttaacaggcaccctcata

SEQ ID NO: 242875 - DNA, 21 bp, Artificial sequence
  SiRNA target sequence
atttaacaggcaccctcatag

SEQ ID NO: 242876 - DNA, 21 bp, Artificial sequence
  SiRNA target sequence
tttaacaggcaccctcataga

SEQ ID NO: 242877 - DNA, 21 bp, Artificial sequence
  SiRNA target sequence
ttaacaggcaccctcatagaa

SEQ ID NO: 242878 - DNA, 21 bp, Artificial sequence
  SiRNA target sequence
taacaggcaccctcatagaaa

SEQ ID NO: 242879 - DNA, 21 bp, Artificial sequence
  SiRNA target sequence
aacaggcaccctcatagaaag

SEQ ID NO: 242880 - DNA, 21 bp, Artificial sequence
  SiRNA target sequence
acaggcaccctcatagaaagc

SEQ ID NO: 242881 - DNA, 21 bp, Artificial sequence
  SiRNA target sequence
caggcaccctcatagaaagca

SEQ ID NO: 242882 - DNA, 21 bp, Artificial sequence
  SiRNA target sequence
aggcaccctcatagaaagcat

SEQ ID NO: 242883 - DNA, 21 bp, Artificial sequence
  SiRNA target sequence
ggcaccctcatagaaagcatt

SEQ ID NO: 242884 - DNA, 21 bp, Artificial sequence
  SiRNA target sequence
gcaccctcatagaaagcattt

SEQ ID NO: 242885 - DNA, 21 bp, Artificial sequence
  SiRNA target sequence
caccctcatagaaagcatttc

SEQ ID NO: 242886 - DNA, 21 bp, Artificial sequence
  SiRNA target sequence
accctcatagaaagcatttct

SEQ ID NO: 242887 - DNA, 21 bp, Artificial sequence
  SiRNA target sequence
ccctcatagaaagcatttctt

SEQ ID NO: 242888 - DNA, 21 bp, Artificial sequence
  SiRNA target sequence
cctcatagaaagcatttcttt

SEQ ID NO: 242889 - DNA, 21 bp, Artificial sequence
  SiRNA target sequence
ctcatagaaagcatttctttt

SEQ ID NO: 242890 - DNA, 21 bp, Artificial sequence
  SiRNA target sequence
tcatagaaagcatttcttttg

SEQ ID NO: 242891 - DNA, 21 bp, Artificial sequence
  SiRNA target sequence
catagaaagcatttcttttgc

SEQ ID NO: 242892 - DNA, 21 bp, Artificial sequence
  SiRNA target sequence
atagaaagcatttcttttgct

SEQ ID NO: 242893 - DNA, 21 bp, Artificial sequence
  SiRNA target sequence
tagaaagcatttcttttgcta

SEQ ID NO: 242894 - DNA, 21 bp, Artificial sequence
  SiRNA target sequence
agaaagcatttcttttgctaa

SEQ ID NO: 242895 - DNA, 21 bp, Artificial sequence
  SiRNA target sequence
gaaagcatttcttttgctaaa

SEQ ID NO: 242896 - DNA, 21 bp, Artificial sequence
  SiRNA target sequence
aaagcatttcttttgctaaat

SEQ ID NO: 242897 - DNA, 21 bp, Artificial sequence
  SiRNA target sequence
aagcatttcttttgctaaatc

SEQ ID NO: 242898 - DNA, 21 bp, Artificial sequence
  SiRNA target sequence
agcatttcttttgctaaatca

SEQ ID NO: 242899 - DNA, 21 bp, Artificial sequence
  SiRNA target sequence
gcatttcttttgctaaatcaa

SEQ ID NO: 242900 - DNA, 21 bp, Artificial sequence
  SiRNA target sequence
catttcttttgctaaatcaaa

SEQ ID NO: 242901 - DNA, 21 bp, Artificial sequence
  SiRNA target sequence
atttcttttgctaaatcaaat

SEQ ID NO: 242902 - DNA, 21 bp, Artificial sequence
  SiRNA target sequence
tttcttttgctaaatcaaata

SEQ ID NO: 242903 - DNA, 21 bp, Artificial sequence
  SiRNA target sequence
ttcttttgctaaatcaaataa

SEQ ID NO: 242904 - DNA, 21 bp, Artificial sequence
  SiRNA target sequence
tcttttgctaaatcaaataaa

SEQ ID NO: 242905 - DNA, 21 bp, Artificial sequence
  SiRNA target sequence
cttttgctaaatcaaataaaa

SEQ ID NO: 242906 - DNA, 21 bp, Artificial sequence
  SiRNA target sequence
ttttgctaaatcaaataaaac

SEQ ID NO: 242907 - DNA, 21 bp, Artificial sequence
  SiRNA target sequence
tttgctaaatcaaataaaaca

SEQ ID NO: 242908 - DNA, 21 bp, Artificial sequence
  SiRNA target sequence
ttgctaaatcaaataaaacat

SEQ ID NO: 242909 - DNA, 21 bp, Artificial sequence
  SiRNA target sequence
tgctaaatcaaataaaacata

SEQ ID NO: 242910 - DNA, 21 bp, Artificial sequence
  SiRNA target sequence
gctaaatcaaataaaacatat

SEQ ID NO: 242911 - DNA, 21 bp, Artificial sequence
  SiRNA target sequence
ctaaatcaaataaaacatatt

SEQ ID NO: 242912 - DNA, 21 bp, Artificial sequence
  SiRNA target sequence
taaatcaaataaaacatattt

SEQ ID NO: 242913 - DNA, 21 bp, Artificial sequence
  SiRNA target sequence
aaatcaaataaaacatatttg

SEQ ID NO: 242914 - DNA, 21 bp, Artificial sequence
  SiRNA target sequence
aatcaaataaaacatatttgg

SEQ ID NO: 242915 - DNA, 21 bp, Artificial sequence
  SiRNA target sequence
atcaaataaaacatatttggt

SEQ ID NO: 242916 - DNA, 21 bp, Artificial sequence
  SiRNA target sequence
tcaaataaaacatatttggta

SEQ ID NO: 242917 - DNA, 21 bp, Artificial sequence
  SiRNA target sequence
caaataaaacatatttggtaa

SEQ ID NO: 242918 - DNA, 21 bp, Artificial sequence
  SiRNA target sequence
aaataaaacatatttggtaat

SEQ ID NO: 242919 - DNA, 21 bp, Artificial sequence
  SiRNA target sequence
aataaaacatatttggtaatt

SEQ ID NO: 242920 - DNA, 21 bp, Artificial sequence
  SiRNA target sequence
ataaaacatatttggtaattt

SEQ ID NO: 242921 - DNA, 21 bp, Artificial sequence
  SiRNA target sequence
taaaacatatttggtaatttt

SEQ ID NO: 242922 - DNA, 21 bp, Artificial sequence
  SiRNA target sequence
aaaacatatttggtaatttta

SEQ ID NO: 242923 - DNA, 21 bp, Artificial sequence
  SiRNA target sequence
aaacatatttggtaattttag

SEQ ID NO: 242924 - DNA, 21 bp, Artificial sequence
  SiRNA target sequence
aacatatttggtaattttaga

SEQ ID NO: 242925 - DNA, 21 bp, Artificial sequence
  SiRNA target sequence
acatatttggtaattttagaa

SEQ ID NO: 242926 - DNA, 21 bp, Artificial sequence
  SiRNA target sequence
catatttggtaattttagaaa

SEQ ID NO: 242927 - DNA, 21 bp, Artificial sequence
  SiRNA target sequence
atatttggtaattttagaaaa

SEQ ID NO: 242928 - DNA, 21 bp, Artificial sequence
  SiRNA target sequence
tatttggtaattttagaaaat

SEQ ID NO: 242929 - DNA, 21 bp, Artificial sequence
  SiRNA target sequence
atttggtaattttagaaaatg

SEQ ID NO: 242930 - DNA, 21 bp, Artificial sequence
  SiRNA target sequence
tttggtaattttagaaaatgc

SEQ ID NO: 242931 - DNA, 21 bp, Artificial sequence
  SiRNA target sequence
ttggtaattttagaaaatgca

SEQ ID NO: 242932 - DNA, 21 bp, Artificial sequence
  SiRNA target sequence
tggtaattttagaaaatgcaa

SEQ ID NO: 242933 - DNA, 21 bp, Artificial sequence
  SiRNA target sequence
ggtaattttagaaaatgcaaa

SEQ ID NO: 242934 - DNA, 21 bp, Artificial sequence
  SiRNA target sequence
gtaattttagaaaatgcaaat

SEQ ID NO: 242935 - DNA, 21 bp, Artificial sequence
  SiRNA target sequence
taattttagaaaatgcaaatc

SEQ ID NO: 242936 - DNA, 21 bp, Artificial sequence
  SiRNA target sequence
aattttagaaaatgcaaatcc

SEQ ID NO: 242937 - DNA, 21 bp, Artificial sequence
  SiRNA target sequence
attttagaaaatgcaaatcca

SEQ ID NO: 242938 - DNA, 21 bp, Artificial sequence
  SiRNA target sequence
ttttagaaaatgcaaatccaa

SEQ ID NO: 242939 - DNA, 21 bp, Artificial sequence
  SiRNA target sequence
tttagaaaatgcaaatccaat

SEQ ID NO: 242940 - DNA, 21 bp, Artificial sequence
  SiRNA target sequence
ttagaaaatgcaaatccaatg

SEQ ID NO: 242941 - DNA, 21 bp, Artificial sequence
  SiRNA target sequence
tagaaaatgcaaatccaatgg

SEQ ID NO: 242942 - DNA, 21 bp, Artificial sequence
  SiRNA target sequence
agaaaatgcaaatccaatggt

SEQ ID NO: 242943 - DNA, 21 bp, Artificial sequence
  SiRNA target sequence
gaaaatgcaaatccaatggtt

SEQ ID NO: 242944 - DNA, 21 bp, Artificial sequence
  SiRNA target sequence
aaaatgcaaatccaatggttg

SEQ ID NO: 242945 - DNA, 21 bp, Artificial sequence
  SiRNA target sequence
aaatgcaaatccaatggttgc

SEQ ID NO: 242946 - DNA, 21 bp, Artificial sequence
  SiRNA target sequence
aatgcaaatccaatggttgca

SEQ ID NO: 242947 - DNA, 21 bp, Artificial sequence
  SiRNA target sequence
atgcaaatccaatggttgcac

SEQ ID NO: 242948 - DNA, 21 bp, Artificial sequence
  SiRNA target sequence
tgcaaatccaatggttgcaca

SEQ ID NO: 242949 - DNA, 21 bp, Artificial sequence
  SiRNA target sequence
gcaaatccaatggttgcacac

SEQ ID NO: 242950 - DNA, 21 bp, Artificial sequence
  SiRNA target sequence
caaatccaatggttgcacacc

SEQ ID NO: 242951 - DNA, 21 bp, Artificial sequence
  SiRNA target sequence
aaatccaatggttgcacacca

SEQ ID NO: 242952 - DNA, 21 bp, Artificial sequence
  SiRNA target sequence
aatccaatggttgcacaccaa

SEQ ID NO: 242953 - DNA, 21 bp, Artificial sequence
  SiRNA target sequence
atccaatggttgcacaccaat

SEQ ID NO: 242954 - DNA, 21 bp, Artificial sequence
  SiRNA target sequence
tccaatggttgcacaccaatt

SEQ ID NO: 242955 - DNA, 21 bp, Artificial sequence
  SiRNA target sequence
ccaatggttgcacaccaattt

SEQ ID NO: 242956 - DNA, 21 bp, Artificial sequence
  SiRNA target sequence
caatggttgcacaccaatttt

SEQ ID NO: 242957 - DNA, 21 bp, Artificial sequence
  SiRNA target sequence
aatggttgcacaccaattttc

SEQ ID NO: 242958 - DNA, 21 bp, Artificial sequence
  SiRNA target sequence
atggttgcacaccaattttca

SEQ ID NO: 242959 - DNA, 21 bp, Artificial sequence
  SiRNA target sequence
tggttgcacaccaattttcaa

SEQ ID NO: 242960 - DNA, 21 bp, Artificial sequence
  SiRNA target sequence
ggttgcacaccaattttcaag

SEQ ID NO: 242961 - DNA, 21 bp, Artificial sequence
  SiRNA target sequence
gttgcacaccaattttcaaga

SEQ ID NO: 242962 - DNA, 21 bp, Artificial sequence
  SiRNA target sequence
ttgcacaccaattttcaagat

SEQ ID NO: 242963 - DNA, 21 bp, Artificial sequence
  SiRNA target sequence
tgcacaccaattttcaagatt

SEQ ID NO: 242964 - DNA, 21 bp, Artificial sequence
  SiRNA target sequence
gcacaccaattttcaagattt

SEQ ID NO: 242965 - DNA, 21 bp, Artificial sequence
  SiRNA target sequence
cacaccaattttcaagattta

SEQ ID NO: 242966 - DNA, 21 bp, Artificial sequence
  SiRNA target sequence
acaccaattttcaagatttat

SEQ ID NO: 242967 - DNA, 21 bp, Artificial sequence
  SiRNA target sequence
caccaattttcaagatttatt

SEQ ID NO: 242968 - DNA, 21 bp, Artificial sequence
  SiRNA target sequence
accaattttcaagatttattc

SEQ ID NO: 242969 - DNA, 21 bp, Artificial sequence
  SiRNA target sequence
ccaattttcaagatttattct

SEQ ID NO: 242970 - DNA, 21 bp, Artificial sequence
  SiRNA target sequence
caattttcaagatttattctt

SEQ ID NO: 242971 - DNA, 21 bp, Artificial sequence
  SiRNA target sequence
aattttcaagatttattctta

SEQ ID NO: 242972 - DNA, 21 bp, Artificial sequence
  SiRNA target sequence
attttcaagatttattcttaa

SEQ ID NO: 242973 - DNA, 21 bp, Artificial sequence
  SiRNA target sequence
ttttcaagatttattcttaag

SEQ ID NO: 242974 - DNA, 21 bp, Artificial sequence
  SiRNA target sequence
tttcaagatttattcttaaga

SEQ ID NO: 242975 - DNA, 21 bp, Artificial sequence
  SiRNA target sequence
ttcaagatttattcttaagac

SEQ ID NO: 242976 - DNA, 21 bp, Artificial sequence
  SiRNA target sequence
tcaagatttattcttaagacc

SEQ ID NO: 242977 - DNA, 21 bp, Artificial sequence
  SiRNA target sequence
caagatttattcttaagaccg

SEQ ID NO: 242978 - DNA, 21 bp, Artificial sequence
  SiRNA target sequence
aagatttattcttaagaccga

SEQ ID NO: 242979 - DNA, 21 bp, Artificial sequence
  SiRNA target sequence
agatttattcttaagaccgat

SEQ ID NO: 242980 - DNA, 21 bp, Artificial sequence
  SiRNA target sequence
gatttattcttaagaccgatg

SEQ ID NO: 242981 - DNA, 21 bp, Artificial sequence
  SiRNA target sequence
atttattcttaagaccgatgg

SEQ ID NO: 242982 - DNA, 21 bp, Artificial sequence
  SiRNA target sequence
tttattcttaagaccgatgga

SEQ ID NO: 242983 - DNA, 21 bp, Artificial sequence
  SiRNA target sequence
ttattcttaagaccgatggag

SEQ ID NO: 242984 - DNA, 21 bp, Artificial sequence
  SiRNA target sequence
tattcttaagaccgatggagc

SEQ ID NO: 242985 - DNA, 21 bp, Artificial sequence
  SiRNA target sequence
attcttaagaccgatggagct

SEQ ID NO: 242986 - DNA, 21 bp, Artificial sequence
  SiRNA target sequence
ttcttaagaccgatggagctg

SEQ ID NO: 242987 - DNA, 21 bp, Artificial sequence
  SiRNA target sequence
tcttaagaccgatggagctgt

SEQ ID NO: 242988 - DNA, 21 bp, Artificial sequence
  SiRNA target sequence
cttaagaccgatggagctgtg

SEQ ID NO: 242989 - DNA, 21 bp, Artificial sequence
  SiRNA target sequence
ttaagaccgatggagctgtgc

SEQ ID NO: 242990 - DNA, 21 bp, Artificial sequence
  SiRNA target sequence
taagaccgatggagctgtgcg

SEQ ID NO: 242991 - DNA, 21 bp, Artificial sequence
  SiRNA target sequence
aagaccgatggagctgtgcgc

SEQ ID NO: 242992 - DNA, 21 bp, Artificial sequence
  SiRNA target sequence
agaccgatggagctgtgcgca

SEQ ID NO: 242993 - DNA, 21 bp, Artificial sequence
  SiRNA target sequence
gaccgatggagctgtgcgcaa

SEQ ID NO: 242994 - DNA, 21 bp, Artificial sequence
  SiRNA target sequence
accgatggagctgtgcgcaaa

SEQ ID NO: 242995 - DNA, 21 bp, Artificial sequence
  SiRNA target sequence
ccgatggagctgtgcgcaaat

SEQ ID NO: 242996 - DNA, 21 bp, Artificial sequence
  SiRNA target sequence
cgatggagctgtgcgcaaatt

SEQ ID NO: 242997 - DNA, 21 bp, Artificial sequence
  SiRNA target sequence
gatggagctgtgcgcaaattg

SEQ ID NO: 242998 - DNA, 21 bp, Artificial sequence
  SiRNA target sequence
atggagctgtgcgcaaattgt

SEQ ID NO: 242999 - DNA, 21 bp, Artificial sequence
  SiRNA target sequence
tggagctgtgcgcaaattgta

SEQ ID NO: 243000 - DNA, 21 bp, Artificial sequence
  SiRNA target sequence
ggagctgtgcgcaaattgtaa

SEQ ID NO: 243001 - DNA, 21 bp, Artificial sequence
  SiRNA target sequence
gagctgtgcgcaaattgtaaa

SEQ ID NO: 243002 - DNA, 21 bp, Artificial sequence
  SiRNA target sequence
agctgtgcgcaaattgtaaaa

SEQ ID NO: 243003 - DNA, 21 bp, Artificial sequence
  SiRNA target sequence
gctgtgcgcaaattgtaaaaa

SEQ ID NO: 243004 - DNA, 21 bp, Artificial sequence
  SiRNA target sequence
ctgtgcgcaaattgtaaaaag

SEQ ID NO: 243005 - DNA, 21 bp, Artificial sequence
  SiRNA target sequence
tgtgcgcaaattgtaaaaaga

SEQ ID NO: 243006 - DNA, 21 bp, Artificial sequence
  SiRNA target sequence
gtgcgcaaattgtaaaaagaa

SEQ ID NO: 243007 - DNA, 21 bp, Artificial sequence
  SiRNA target sequence
tgcgcaaattgtaaaaagaaa

SEQ ID NO: 243008 - DNA, 21 bp, Artificial sequence
  SiRNA target sequence
gcgcaaattgtaaaaagaaag

SEQ ID NO: 243009 - DNA, 21 bp, Artificial sequence
  SiRNA target sequence
cgcaaattgtaaaaagaaagt

SEQ ID NO: 243010 - DNA, 21 bp, Artificial sequence
  SiRNA target sequence
gcaaattgtaaaaagaaagtc

SEQ ID NO: 243011 - DNA, 21 bp, Artificial sequence
  SiRNA target sequence
caaattgtaaaaagaaagtcc

SEQ ID NO: 243012 - DNA, 21 bp, Artificial sequence
  SiRNA target sequence
aaattgtaaaaagaaagtcct

SEQ ID NO: 243013 - DNA, 21 bp, Artificial sequence
  SiRNA target sequence
aattgtaaaaagaaagtcctg

SEQ ID NO: 243014 - DNA, 21 bp, Artificial sequence
  SiRNA target sequence
attgtaaaaagaaagtcctga

SEQ ID NO: 243015 - DNA, 21 bp, Artificial sequence
  SiRNA target sequence
ttgtaaaaagaaagtcctgaa

SEQ ID NO: 243016 - DNA, 21 bp, Artificial sequence
  SiRNA target sequence
tgtaaaaagaaagtcctgaaa

SEQ ID NO: 243017 - DNA, 21 bp, Artificial sequence
  SiRNA target sequence
gtaaaaagaaagtcctgaaat

SEQ ID NO: 243018 - DNA, 21 bp, Artificial sequence
  SiRNA target sequence
taaaaagaaagtcctgaaatt

SEQ ID NO: 243019 - DNA, 21 bp, Artificial sequence
  SiRNA target sequence
aaaaagaaagtcctgaaatta

SEQ ID NO: 243020 - DNA, 21 bp, Artificial sequence
  SiRNA target sequence
aaaagaaagtcctgaaattag

SEQ ID NO: 243021 - DNA, 21 bp, Artificial sequence
  SiRNA target sequence
aaagaaagtcctgaaattaga

SEQ ID NO: 243022 - DNA, 21 bp, Artificial sequence
  SiRNA target sequence
aagaaagtcctgaaattagag

SEQ ID NO: 243023 - DNA, 21 bp, Artificial sequence
  SiRNA target sequence
agaaagtcctgaaattagagc

SEQ ID NO: 243024 - DNA, 21 bp, Artificial sequence
  SiRNA target sequence
gaaagtcctgaaattagagcg

SEQ ID NO: 243025 - DNA, 21 bp, Artificial sequence
  SiRNA target sequence
aaagtcctgaaattagagcgg

SEQ ID NO: 243026 - DNA, 21 bp, Artificial sequence
  SiRNA target sequence
aagtcctgaaattagagcggt

SEQ ID NO: 243027 - DNA, 21 bp, Artificial sequence
  SiRNA target sequence
agtcctgaaattagagcggta

SEQ ID NO: 243028 - DNA, 21 bp, Artificial sequence
  SiRNA target sequence
gtcctgaaattagagcggtaa

SEQ ID NO: 243029 - DNA, 21 bp, Artificial sequence
  SiRNA target sequence
tcctgaaattagagcggtaaa

SEQ ID NO: 243030 - DNA, 21 bp, Artificial sequence
  SiRNA target sequence
cctgaaattagagcggtaaaa

SEQ ID NO: 243031 - DNA, 21 bp, Artificial sequence
  SiRNA target sequence
ctgaaattagagcggtaaaaa

SEQ ID NO: 243032 - DNA, 21 bp, Artificial sequence
  SiRNA target sequence
tgaaattagagcggtaaaaaa

SEQ ID NO: 243033 - DNA, 21 bp, Artificial sequence
  SiRNA target sequence
gaaattagagcggtaaaaaat

SEQ ID NO: 243034 - DNA, 21 bp, Artificial sequence
  SiRNA target sequence
aaattagagcggtaaaaaata

SEQ ID NO: 243035 - DNA, 21 bp, Artificial sequence
  SiRNA target sequence
aattagagcggtaaaaaatat

SEQ ID NO: 243036 - DNA, 21 bp, Artificial sequence
  SiRNA target sequence
attagagcggtaaaaaatata

SEQ ID NO: 243037 - DNA, 21 bp, Artificial sequence
  SiRNA target sequence
ttagagcggtaaaaaatatag

SEQ ID NO: 243038 - DNA, 21 bp, Artificial sequence
  SiRNA target sequence
tagagcggtaaaaaatatagc

SEQ ID NO: 243039 - DNA, 21 bp, Artificial sequence
  SiRNA target sequence
agagcggtaaaaaatatagca

SEQ ID NO: 243040 - DNA, 21 bp, Artificial sequence
  SiRNA target sequence
gagcggtaaaaaatatagcag

SEQ ID NO: 243041 - DNA, 21 bp, Artificial sequence
  SiRNA target sequence
agcggtaaaaaatatagcagc

SEQ ID NO: 243042 - DNA, 21 bp, Artificial sequence
  SiRNA target sequence
gcggtaaaaaatatagcagca

SEQ ID NO: 243043 - DNA, 21 bp, Artificial sequence
  SiRNA target sequence
cggtaaaaaatatagcagcaa

SEQ ID NO: 243044 - DNA, 21 bp, Artificial sequence
  SiRNA target sequence
ggtaaaaaatatagcagcaat

SEQ ID NO: 243045 - DNA, 21 bp, Artificial sequence
  SiRNA target sequence
gtaaaaaatatagcagcaata

SEQ ID NO: 243046 - DNA, 21 bp, Artificial sequence
  SiRNA target sequence
taaaaaatatagcagcaatag

SEQ ID NO: 243047 - DNA, 21 bp, Artificial sequence
  SiRNA target sequence
aaaaaatatagcagcaatagg

SEQ ID NO: 243048 - DNA, 21 bp, Artificial sequence
  SiRNA target sequence
aaaaatatagcagcaataggg

SEQ ID NO: 243049 - DNA, 21 bp, Artificial sequence
  SiRNA target sequence
aaaatatagcagcaatagggg

SEQ ID NO: 243050 - DNA, 21 bp, Artificial sequence
  SiRNA target sequence
aaatatagcagcaatagggga

SEQ ID NO: 243051 - DNA, 21 bp, Artificial sequence
  SiRNA target sequence
aatatagcagcaataggggag

SEQ ID NO: 243052 - DNA, 21 bp, Artificial sequence
  SiRNA target sequence
atatagcagcaataggggagg

SEQ ID NO: 243053 - DNA, 21 bp, Artificial sequence
  SiRNA target sequence
tatagcagcaataggggaggc

SEQ ID NO: 243054 - DNA, 21 bp, Artificial sequence
  SiRNA target sequence
atagcagcaataggggaggca

SEQ ID NO: 243055 - DNA, 21 bp, Artificial sequence
  SiRNA target sequence
tagcagcaataggggaggcaa

SEQ ID NO: 243056 - DNA, 21 bp, Artificial sequence
  SiRNA target sequence
agcagcaataggggaggcaat

SEQ ID NO: 243057 - DNA, 21 bp, Artificial sequence
  SiRNA target sequence
gcagcaataggggaggcaata

SEQ ID NO: 243058 - DNA, 21 bp, Artificial sequence
  SiRNA target sequence
cagcaataggggaggcaatag

SEQ ID NO: 243059 - DNA, 21 bp, Artificial sequence
  SiRNA target sequence
agcaataggggaggcaataga

SEQ ID NO: 243060 - DNA, 21 bp, Artificial sequence
  SiRNA target sequence
gcaataggggaggcaatagat

SEQ ID NO: 243061 - DNA, 21 bp, Artificial sequence
  SiRNA target sequence
caataggggaggcaatagata

SEQ ID NO: 243062 - DNA, 21 bp, Artificial sequence
  SiRNA target sequence
aataggggaggcaatagatag

SEQ ID NO: 243063 - DNA, 21 bp, Artificial sequence
  SiRNA target sequence
ataggggaggcaatagataga

SEQ ID NO: 243064 - DNA, 21 bp, Artificial sequence
  SiRNA target sequence
taggggaggcaatagatagat

SEQ ID NO: 243065 - DNA, 21 bp, Artificial sequence
  SiRNA target sequence
aggggaggcaatagatagata

SEQ ID NO: 243066 - DNA, 21 bp, Artificial sequence
  SiRNA target sequence
ggggaggcaatagatagataa

SEQ ID NO: 243067 - DNA, 21 bp, Artificial sequence
  SiRNA target sequence
gggaggcaatagatagataaa

SEQ ID NO: 243068 - DNA, 21 bp, Artificial sequence
  SiRNA target sequence
ggaggcaatagatagataaaa

SEQ ID NO: 243069 - DNA, 21 bp, Artificial sequence
  SiRNA target sequence
gaggcaatagatagataaaag

SEQ ID NO: 243070 - DNA, 21 bp, Artificial sequence
  SiRNA target sequence
aggcaatagatagataaaaga

SEQ ID NO: 243071 - DNA, 21 bp, Artificial sequence
  SiRNA target sequence
ggcaatagatagataaaagat

SEQ ID NO: 243072 - DNA, 21 bp, Artificial sequence
  SiRNA target sequence
gcaatagatagataaaagatc

SEQ ID NO: 243073 - DNA, 21 bp, Artificial sequence
  SiRNA target sequence
caatagatagataaaagatcc

SEQ ID NO: 243074 - DNA, 21 bp, Artificial sequence
  SiRNA target sequence
aatagatagataaaagatcct

SEQ ID NO: 243075 - DNA, 21 bp, Artificial sequence
  SiRNA target sequence
atagatagataaaagatcctt

SEQ ID NO: 243076 - DNA, 21 bp, Artificial sequence
  SiRNA target sequence
tagatagataaaagatccttg

SEQ ID NO: 243077 - DNA, 21 bp, Artificial sequence
  SiRNA target sequence
agatagataaaagatccttga

SEQ ID NO: 243078 - DNA, 21 bp, Artificial sequence
  SiRNA target sequence
gatagataaaagatccttgat

SEQ ID NO: 243079 - DNA, 21 bp, Artificial sequence
  SiRNA target sequence
atagataaaagatccttgatg

SEQ ID NO: 243080 - DNA, 21 bp, Artificial sequence
  SiRNA target sequence
tagataaaagatccttgatgc

SEQ ID NO: 243081 - DNA, 21 bp, Artificial sequence
  SiRNA target sequence
agataaaagatccttgatgca

SEQ ID NO: 243082 - DNA, 21 bp, Artificial sequence
  SiRNA target sequence
gataaaagatccttgatgcaa

SEQ ID NO: 243083 - DNA, 21 bp, Artificial sequence
  SiRNA target sequence
ataaaagatccttgatgcaat

SEQ ID NO: 243084 - DNA, 21 bp, Artificial sequence
  SiRNA target sequence
taaaagatccttgatgcaatg

SEQ ID NO: 243085 - DNA, 21 bp, Artificial sequence
  SiRNA target sequence
aaaagatccttgatgcaatgc

SEQ ID NO: 243086 - DNA, 21 bp, Artificial sequence
  SiRNA target sequence
aaagatccttgatgcaatgcg

SEQ ID NO: 243087 - DNA, 21 bp, Artificial sequence
  SiRNA target sequence
aagatccttgatgcaatgcga

SEQ ID NO: 243088 - DNA, 21 bp, Artificial sequence
  SiRNA target sequence
agatccttgatgcaatgcgat

SEQ ID NO: 243089 - DNA, 21 bp, Artificial sequence
  SiRNA target sequence
gatccttgatgcaatgcgatt

SEQ ID NO: 243090 - DNA, 21 bp, Artificial sequence
  SiRNA target sequence
atccttgatgcaatgcgattt

SEQ ID NO: 243091 - DNA, 21 bp, Artificial sequence
  SiRNA target sequence
tccttgatgcaatgcgatttc

SEQ ID NO: 243092 - DNA, 21 bp, Artificial sequence
  SiRNA target sequence
ccttgatgcaatgcgatttcc

SEQ ID NO: 243093 - DNA, 21 bp, Artificial sequence
  SiRNA target sequence
cttgatgcaatgcgatttcca

SEQ ID NO: 243094 - DNA, 21 bp, Artificial sequence
  SiRNA target sequence
ttgatgcaatgcgatttccac

SEQ ID NO: 243095 - DNA, 21 bp, Artificial sequence
  SiRNA target sequence
tgatgcaatgcgatttccacg

SEQ ID NO: 243096 - DNA, 21 bp, Artificial sequence
  SiRNA target sequence
gatgcaatgcgatttccacgg

SEQ ID NO: 243097 - DNA, 21 bp, Artificial sequence
  SiRNA target sequence
atgcaatgcgatttccacgga

SEQ ID NO: 243098 - DNA, 21 bp, Artificial sequence
  SiRNA target sequence
tgcaatgcgatttccacggat

SEQ ID NO: 243099 - DNA, 21 bp, Artificial sequence
  SiRNA target sequence
gcaatgcgatttccacggatt

SEQ ID NO: 243100 - DNA, 21 bp, Artificial sequence
  SiRNA target sequence
caatgcgatttccacggatta

SEQ ID NO: 243101 - DNA, 21 bp, Artificial sequence
  SiRNA target sequence
aatgcgatttccacggattac

SEQ ID NO: 243102 - DNA, 21 bp, Artificial sequence
  SiRNA target sequence
atgcgatttccacggattaca

SEQ ID NO: 243103 - DNA, 21 bp, Artificial sequence
  SiRNA target sequence
tgcgatttccacggattacaa

SEQ ID NO: 243104 - DNA, 21 bp, Artificial sequence
  SiRNA target sequence
gcgatttccacggattacaaa

SEQ ID NO: 243105 - DNA, 21 bp, Artificial sequence
  SiRNA target sequence
cgatttccacggattacaaag

SEQ ID NO: 243106 - DNA, 21 bp, Artificial sequence
  SiRNA target sequence
gatttccacggattacaaagt

SEQ ID NO: 243107 - DNA, 21 bp, Artificial sequence
  SiRNA target sequence
atttccacggattacaaagtt

SEQ ID NO: 243108 - DNA, 21 bp, Artificial sequence
  SiRNA target sequence
tttccacggattacaaagtta

SEQ ID NO: 243109 - DNA, 21 bp, Artificial sequence
  SiRNA target sequence
ttccacggattacaaagttat

SEQ ID NO: 243110 - DNA, 21 bp, Artificial sequence
  SiRNA target sequence
tccacggattacaaagttata

SEQ ID NO: 243111 - DNA, 21 bp, Artificial sequence
  SiRNA target sequence
ccacggattacaaagttataa

SEQ ID NO: 243112 - DNA, 21 bp, Artificial sequence
  SiRNA target sequence
cacggattacaaagttataaa

SEQ ID NO: 243113 - DNA, 21 bp, Artificial sequence
  SiRNA target sequence
acggattacaaagttataaaa

SEQ ID NO: 243114 - DNA, 21 bp, Artificial sequence
  SiRNA target sequence
cggattacaaagttataaaat

SEQ ID NO: 243115 - DNA, 21 bp, Artificial sequence
  SiRNA target sequence
ggattacaaagttataaaata

SEQ ID NO: 243116 - DNA, 21 bp, Artificial sequence
  SiRNA target sequence
gattacaaagttataaaataa

SEQ ID NO: 243117 - DNA, 21 bp, Artificial sequence
  SiRNA target sequence
attacaaagttataaaataat

SEQ ID NO: 243118 - DNA, 21 bp, Artificial sequence
  SiRNA target sequence
ttacaaagttataaaataatg

SEQ ID NO: 243119 - DNA, 21 bp, Artificial sequence
  SiRNA target sequence
tacaaagttataaaataatga

SEQ ID NO: 243120 - DNA, 21 bp, Artificial sequence
  SiRNA target sequence
acaaagttataaaataatgat

SEQ ID NO: 243121 - DNA, 21 bp, Artificial sequence
  SiRNA target sequence
caaagttataaaataatgata

SEQ ID NO: 243122 - DNA, 21 bp, Artificial sequence
  SiRNA target sequence
aaagttataaaataatgatac

SEQ ID NO: 243123 - DNA, 21 bp, Artificial sequence
  SiRNA target sequence
aagttataaaataatgataca

SEQ ID NO: 243124 - DNA, 21 bp, Artificial sequence
  SiRNA target sequence
agttataaaataatgatacag

SEQ ID NO: 243125 - DNA, 21 bp, Artificial sequence
  SiRNA target sequence
gttataaaataatgatacagc

SEQ ID NO: 243126 - DNA, 21 bp, Artificial sequence
  SiRNA target sequence
ttataaaataatgatacagca

SEQ ID NO: 243127 - DNA, 21 bp, Artificial sequence
  SiRNA target sequence
tataaaataatgatacagcac

SEQ ID NO: 243128 - DNA, 21 bp, Artificial sequence
  SiRNA target sequence
ataaaataatgatacagcact

SEQ ID NO: 243129 - DNA, 21 bp, Artificial sequence
  SiRNA target sequence
taaaataatgatacagcacta

SEQ ID NO: 243130 - DNA, 21 bp, Artificial sequence
  SiRNA target sequence
aaaataatgatacagcactaa

SEQ ID NO: 243131 - DNA, 21 bp, Artificial sequence
  SiRNA target sequence
aaataatgatacagcactaat

SEQ ID NO: 243132 - DNA, 21 bp, Artificial sequence
  SiRNA target sequence
aataatgatacagcactaatc

SEQ ID NO: 243133 - DNA, 21 bp, Artificial sequence
  SiRNA target sequence
ataatgatacagcactaatcg

SEQ ID NO: 243134 - DNA, 21 bp, Artificial sequence
  SiRNA target sequence
taatgatacagcactaatcgt

SEQ ID NO: 243135 - DNA, 21 bp, Artificial sequence
  SiRNA target sequence
aatgatacagcactaatcgtt

SEQ ID NO: 243136 - DNA, 21 bp, Artificial sequence
  SiRNA target sequence
atgatacagcactaatcgtta

SEQ ID NO: 243137 - DNA, 21 bp, Artificial sequence
  SiRNA target sequence
tgatacagcactaatcgttaa

SEQ ID NO: 243138 - DNA, 21 bp, Artificial sequence
  SiRNA target sequence
gatacagcactaatcgttaag

SEQ ID NO: 243139 - DNA, 21 bp, Artificial sequence
  SiRNA target sequence
atacagcactaatcgttaagg

SEQ ID NO: 243140 - DNA, 21 bp, Artificial sequence
  SiRNA target sequence
tacagcactaatcgttaagga

SEQ ID NO: 243141 - DNA, 21 bp, Artificial sequence
  SiRNA target sequence
acagcactaatcgttaaggaa

SEQ ID NO: 243142 - DNA, 21 bp, Artificial sequence
  SiRNA target sequence
cagcactaatcgttaaggaag

SEQ ID NO: 243143 - DNA, 21 bp, Artificial sequence
  SiRNA target sequence
agcactaatcgttaaggaagt

SEQ ID NO: 243144 - DNA, 21 bp, Artificial sequence
  SiRNA target sequence
gcactaatcgttaaggaagtt

SEQ ID NO: 243145 - DNA, 21 bp, Artificial sequence
  SiRNA target sequence
cactaatcgttaaggaagttg

SEQ ID NO: 243146 - DNA, 21 bp, Artificial sequence
  SiRNA target sequence
actaatcgttaaggaagttgt

SEQ ID NO: 243147 - DNA, 21 bp, Artificial sequence
  SiRNA target sequence
ctaatcgttaaggaagttgtt

SEQ ID NO: 243148 - DNA, 21 bp, Artificial sequence
  SiRNA target sequence
taatcgttaaggaagttgtta

SEQ ID NO: 243149 - DNA, 21 bp, Artificial sequence
  SiRNA target sequence
aatcgttaaggaagttgttac

SEQ ID NO: 243150 - DNA, 21 bp, Artificial sequence
  SiRNA target sequence
atcgttaaggaagttgttact

SEQ ID NO: 243151 - DNA, 21 bp, Artificial sequence
  SiRNA target sequence
tcgttaaggaagttgttacta

SEQ ID NO: 243152 - DNA, 21 bp, Artificial sequence
  SiRNA target sequence
cgttaaggaagttgttactaa

SEQ ID NO: 243153 - DNA, 21 bp, Artificial sequence
  SiRNA target sequence
gttaaggaagttgttactaaa

SEQ ID NO: 243154 - DNA, 21 bp, Artificial sequence
  SiRNA target sequence
ttaaggaagttgttactaaat

SEQ ID NO: 243155 - DNA, 21 bp, Artificial sequence
  SiRNA target sequence
taaggaagttgttactaaata

SEQ ID NO: 243156 - DNA, 21 bp, Artificial sequence
  SiRNA target sequence
aaggaagttgttactaaatat

SEQ ID NO: 243157 - DNA, 21 bp, Artificial sequence
  SiRNA target sequence
aggaagttgttactaaatatt

SEQ ID NO: 243158 - DNA, 21 bp, Artificial sequence
  SiRNA target sequence
ggaagttgttactaaatattt

SEQ ID NO: 243159 - DNA, 21 bp, Artificial sequence
  SiRNA target sequence
gaagttgttactaaatatttt

SEQ ID NO: 243160 - DNA, 21 bp, Artificial sequence
  SiRNA target sequence
aagttgttactaaatattttt

SEQ ID NO: 243161 - DNA, 21 bp, Artificial sequence
  SiRNA target sequence
agttgttactaaatatttttg

SEQ ID NO: 243162 - DNA, 21 bp, Artificial sequence
  SiRNA target sequence
gttgttactaaatatttttga

SEQ ID NO: 243163 - DNA, 21 bp, Artificial sequence
  SiRNA target sequence
ttgttactaaatatttttgag

SEQ ID NO: 243164 - DNA, 21 bp, Artificial sequence
  SiRNA target sequence
tgttactaaatatttttgaga

SEQ ID NO: 243165 - DNA, 21 bp, Artificial sequence
  SiRNA target sequence
gttactaaatatttttgagaa

SEQ ID NO: 243166 - DNA, 21 bp, Artificial sequence
  SiRNA target sequence
ttactaaatatttttgagaat

SEQ ID NO: 243167 - DNA, 21 bp, Artificial sequence
  SiRNA target sequence
tactaaatatttttgagaata

SEQ ID NO: 243168 - DNA, 21 bp, Artificial sequence
  SiRNA target sequence
actaaatatttttgagaataa

SEQ ID NO: 243169 - DNA, 21 bp, Artificial sequence
  SiRNA target sequence
ctaaatatttttgagaataat

SEQ ID NO: 243170 - DNA, 21 bp, Artificial sequence
  SiRNA target sequence
taaatatttttgagaataatc

SEQ ID NO: 243171 - DNA, 21 bp, Artificial sequence
  SiRNA target sequence
aaatatttttgagaataatct

SEQ ID NO: 243172 - DNA, 21 bp, Artificial sequence
  SiRNA target sequence
aatatttttgagaataatctt

SEQ ID NO: 243173 - DNA, 21 bp, Artificial sequence
  SiRNA target sequence
atatttttgagaataatcttt

SEQ ID NO: 243174 - DNA, 21 bp, Artificial sequence
  SiRNA target sequence
tatttttgagaataatctttc

SEQ ID NO: 243175 - DNA, 21 bp, Artificial sequence
  SiRNA target sequence
atttttgagaataatctttcg

SEQ ID NO: 243176 - DNA, 21 bp, Artificial sequence
  SiRNA target sequence
tttttgagaataatctttcgg

SEQ ID NO: 243177 - DNA, 21 bp, Artificial sequence
  SiRNA target sequence
ttttgagaataatctttcgga

SEQ ID NO: 243178 - DNA, 21 bp, Artificial sequence
  SiRNA target sequence
tttgagaataatctttcggag

SEQ ID NO: 243179 - DNA, 21 bp, Artificial sequence
  SiRNA target sequence
ttgagaataatctttcggagg

SEQ ID NO: 243180 - DNA, 21 bp, Artificial sequence
  SiRNA target sequence
tgagaataatctttcggaggc

SEQ ID NO: 243181 - DNA, 21 bp, Artificial sequence
  SiRNA target sequence
gagaataatctttcggaggca

SEQ ID NO: 243182 - DNA, 21 bp, Artificial sequence
  SiRNA target sequence
agaataatctttcggaggcat

SEQ ID NO: 243183 - DNA, 21 bp, Artificial sequence
  SiRNA target sequence
gaataatctttcggaggcata

SEQ ID NO: 243184 - DNA, 21 bp, Artificial sequence
  SiRNA target sequence
aataatctttcggaggcatat

SEQ ID NO: 243185 - DNA, 21 bp, Artificial sequence
  SiRNA target sequence
ataatctttcggaggcatatt

SEQ ID NO: 243186 - DNA, 21 bp, Artificial sequence
  SiRNA target sequence
taatctttcggaggcatatta

SEQ ID NO: 243187 - DNA, 21 bp, Artificial sequence
  SiRNA target sequence
aatctttcggaggcatattat

SEQ ID NO: 243188 - DNA, 21 bp, Artificial sequence
  SiRNA target sequence
atctttcggaggcatattatt

SEQ ID NO: 243189 - DNA, 21 bp, Artificial sequence
  SiRNA target sequence
tctttcggaggcatattatta

SEQ ID NO: 243190 - DNA, 21 bp, Artificial sequence
  SiRNA target sequence
ctttcggaggcatattattaa

SEQ ID NO: 243191 - DNA, 21 bp, Artificial sequence
  SiRNA target sequence
tttcggaggcatattattaat

SEQ ID NO: 243192 - DNA, 21 bp, Artificial sequence
  SiRNA target sequence
ttcggaggcatattattaatt

SEQ ID NO: 243193 - DNA, 21 bp, Artificial sequence
  SiRNA target sequence
tcggaggcatattattaattc

SEQ ID NO: 243194 - DNA, 21 bp, Artificial sequence
  SiRNA target sequence
cggaggcatattattaattct

SEQ ID NO: 243195 - DNA, 21 bp, Artificial sequence
  SiRNA target sequence
ggaggcatattattaattctg

SEQ ID NO: 243196 - DNA, 21 bp, Artificial sequence
  SiRNA target sequence
gaggcatattattaattctgc

SEQ ID NO: 243197 - DNA, 21 bp, Artificial sequence
  SiRNA target sequence
aggcatattattaattctgct

SEQ ID NO: 243198 - DNA, 21 bp, Artificial sequence
  SiRNA target sequence
ggcatattattaattctgctt

SEQ ID NO: 243199 - DNA, 21 bp, Artificial sequence
  SiRNA target sequence
gcatattattaattctgcttc

SEQ ID NO: 243200 - DNA, 21 bp, Artificial sequence
  SiRNA target sequence
catattattaattctgcttcc

SEQ ID NO: 243201 - DNA, 21 bp, Artificial sequence
  SiRNA target sequence
atattattaattctgcttccc

SEQ ID NO: 243202 - DNA, 21 bp, Artificial sequence
  SiRNA target sequence
tattattaattctgcttcccg

SEQ ID NO: 243203 - DNA, 21 bp, Artificial sequence
  SiRNA target sequence
attattaattctgcttcccgt

SEQ ID NO: 243204 - DNA, 21 bp, Artificial sequence
  SiRNA target sequence
ttattaattctgcttcccgta

SEQ ID NO: 243205 - DNA, 21 bp, Artificial sequence
  SiRNA target sequence
tattaattctgcttcccgtag

SEQ ID NO: 243206 - DNA, 21 bp, Artificial sequence
  SiRNA target sequence
attaattctgcttcccgtaga

SEQ ID NO: 243207 - DNA, 21 bp, Artificial sequence
  SiRNA target sequence
ttaattctgcttcccgtagat

SEQ ID NO: 243208 - DNA, 21 bp, Artificial sequence
  SiRNA target sequence
taattctgcttcccgtagata

SEQ ID NO: 243209 - DNA, 21 bp, Artificial sequence
  SiRNA target sequence
aattctgcttcccgtagataa

SEQ ID NO: 243210 - DNA, 21 bp, Artificial sequence
  SiRNA target sequence
attctgcttcccgtagataaa

SEQ ID NO: 243211 - DNA, 21 bp, Artificial sequence
  SiRNA target sequence
ttctgcttcccgtagataaag

SEQ ID NO: 243212 - DNA, 21 bp, Artificial sequence
  SiRNA target sequence
tctgcttcccgtagataaaga

SEQ ID NO: 243213 - DNA, 21 bp, Artificial sequence
  SiRNA target sequence
ctgcttcccgtagataaagaa

SEQ ID NO: 243214 - DNA, 21 bp, Artificial sequence
  SiRNA target sequence
tgcttcccgtagataaagaat

SEQ ID NO: 243215 - DNA, 21 bp, Artificial sequence
  SiRNA target sequence
gcttcccgtagataaagaatt

SEQ ID NO: 243216 - DNA, 21 bp, Artificial sequence
  SiRNA target sequence
cttcccgtagataaagaattt

SEQ ID NO: 243217 - DNA, 21 bp, Artificial sequence
  SiRNA target sequence
ttcccgtagataaagaatttt

SEQ ID NO: 243218 - DNA, 21 bp, Artificial sequence
  SiRNA target sequence
tcccgtagataaagaattttt

SEQ ID NO: 243219 - DNA, 21 bp, Artificial sequence
  SiRNA target sequence
cccgtagataaagaatttttt

SEQ ID NO: 243220 - DNA, 21 bp, Artificial sequence
  SiRNA target sequence
ccgtagataaagaatttttta

SEQ ID NO: 243221 - DNA, 21 bp, Artificial sequence
  SiRNA target sequence
cgtagataaagaattttttaa

SEQ ID NO: 243222 - DNA, 21 bp, Artificial sequence
  SiRNA target sequence
gtagataaagaattttttaag

SEQ ID NO: 243223 - DNA, 21 bp, Artificial sequence
  SiRNA target sequence
tagataaagaattttttaagg

SEQ ID NO: 243224 - DNA, 21 bp, Artificial sequence
  SiRNA target sequence
agataaagaattttttaagga

SEQ ID NO: 243225 - DNA, 21 bp, Artificial sequence
  SiRNA target sequence
gataaagaattttttaaggac

SEQ ID NO: 243226 - DNA, 21 bp, Artificial sequence
  SiRNA target sequence
ataaagaattttttaaggaca

SEQ ID NO: 243227 - DNA, 21 bp, Artificial sequence
  SiRNA target sequence
taaagaattttttaaggacat

SEQ ID NO: 243228 - DNA, 21 bp, Artificial sequence
  SiRNA target sequence
aaagaattttttaaggacata

SEQ ID NO: 243229 - DNA, 21 bp, Artificial sequence
  SiRNA target sequence
aagaattttttaaggacatat

SEQ ID NO: 243230 - DNA, 21 bp, Artificial sequence
  SiRNA target sequence
agaattttttaaggacatatc

SEQ ID NO: 243231 - DNA, 21 bp, Artificial sequence
  SiRNA target sequence
gaattttttaaggacatatca

SEQ ID NO: 243232 - DNA, 21 bp, Artificial sequence
  SiRNA target sequence
aattttttaaggacatatcaa

SEQ ID NO: 243233 - DNA, 21 bp, Artificial sequence
  SiRNA target sequence
attttttaaggacatatcaat

SEQ ID NO: 243234 - DNA, 21 bp, Artificial sequence
  SiRNA target sequence
ttttttaaggacatatcaata

SEQ ID NO: 243235 - DNA, 21 bp, Artificial sequence
  SiRNA target sequence
tttttaaggacatatcaataa

SEQ ID NO: 243236 - DNA, 21 bp, Artificial sequence
  SiRNA target sequence
ttttaaggacatatcaataaa

SEQ ID NO: 243237 - DNA, 21 bp, Artificial sequence
  SiRNA target sequence
tttaaggacatatcaataaat

SEQ ID NO: 243238 - DNA, 21 bp, Artificial sequence
  SiRNA target sequence
ttaaggacatatcaataaatc

SEQ ID NO: 243239 - DNA, 21 bp, Artificial sequence
  SiRNA target sequence
taaggacatatcaataaatcc

SEQ ID NO: 243240 - DNA, 21 bp, Artificial sequence
  SiRNA target sequence
aaggacatatcaataaatcct

SEQ ID NO: 243241 - DNA, 21 bp, Artificial sequence
  SiRNA target sequence
aggacatatcaataaatcctg

SEQ ID NO: 243242 - DNA, 21 bp, Artificial sequence
  SiRNA target sequence
ggacatatcaataaatcctgc

SEQ ID NO: 243243 - DNA, 21 bp, Artificial sequence
  SiRNA target sequence
gacatatcaataaatcctgca

SEQ ID NO: 243244 - DNA, 21 bp, Artificial sequence
  SiRNA target sequence
acatatcaataaatcctgcat

SEQ ID NO: 243245 - DNA, 21 bp, Artificial sequence
  SiRNA target sequence
catatcaataaatcctgcatt

SEQ ID NO: 243246 - DNA, 21 bp, Artificial sequence
  SiRNA target sequence
atatcaataaatcctgcatta

SEQ ID NO: 243247 - DNA, 21 bp, Artificial sequence
  SiRNA target sequence
tatcaataaatcctgcattaa

SEQ ID NO: 243248 - DNA, 21 bp, Artificial sequence
  SiRNA target sequence
atcaataaatcctgcattaat

SEQ ID NO: 243249 - DNA, 21 bp, Artificial sequence
  SiRNA target sequence
tcaataaatcctgcattaata

SEQ ID NO: 243250 - DNA, 21 bp, Artificial sequence
  SiRNA target sequence
caataaatcctgcattaatag

SEQ ID NO: 243251 - DNA, 21 bp, Artificial sequence
  SiRNA target sequence
aataaatcctgcattaatagc

SEQ ID NO: 243252 - DNA, 21 bp, Artificial sequence
  SiRNA target sequence
ataaatcctgcattaatagca

SEQ ID NO: 243253 - DNA, 21 bp, Artificial sequence
  SiRNA target sequence
taaatcctgcattaatagcat

SEQ ID NO: 243254 - DNA, 21 bp, Artificial sequence
  SiRNA target sequence
aaatcctgcattaatagcata

SEQ ID NO: 243255 - DNA, 21 bp, Artificial sequence
  SiRNA target sequence
aatcctgcattaatagcatag

SEQ ID NO: 243256 - DNA, 21 bp, Artificial sequence
  SiRNA target sequence
atcctgcattaatagcataga

SEQ ID NO: 243257 - DNA, 21 bp, Artificial sequence
  SiRNA target sequence
tcctgcattaatagcatagat

SEQ ID NO: 243258 - DNA, 21 bp, Artificial sequence
  SiRNA target sequence
cctgcattaatagcatagatt

SEQ ID NO: 243259 - DNA, 21 bp, Artificial sequence
  SiRNA target sequence
ctgcattaatagcatagatta

SEQ ID NO: 243260 - DNA, 21 bp, Artificial sequence
  SiRNA target sequence
tgcattaatagcatagattaa

SEQ ID NO: 243261 - DNA, 21 bp, Artificial sequence
  SiRNA target sequence
gcattaatagcatagattaat

SEQ ID NO: 243262 - DNA, 21 bp, Artificial sequence
  SiRNA target sequence
cattaatagcatagattaatg

SEQ ID NO: 243263 - DNA, 21 bp, Artificial sequence
  SiRNA target sequence
attaatagcatagattaatgc

SEQ ID NO: 243264 - DNA, 21 bp, Artificial sequence
  SiRNA target sequence
ttaatagcatagattaatgcc

SEQ ID NO: 243265 - DNA, 21 bp, Artificial sequence
  SiRNA target sequence
taatagcatagattaatgccg

SEQ ID NO: 243266 - DNA, 21 bp, Artificial sequence
  SiRNA target sequence
aatagcatagattaatgccgc

SEQ ID NO: 243267 - DNA, 21 bp, Artificial sequence
  SiRNA target sequence
atagcatagattaatgccgct

SEQ ID NO: 243268 - DNA, 21 bp, Artificial sequence
  SiRNA target sequence
tagcatagattaatgccgctg

SEQ ID NO: 243269 - DNA, 21 bp, Artificial sequence
  SiRNA target sequence
agcatagattaatgccgctgc

SEQ ID NO: 243270 - DNA, 21 bp, Artificial sequence
  SiRNA target sequence
gcatagattaatgccgctgca

SEQ ID NO: 243271 - DNA, 21 bp, Artificial sequence
  SiRNA target sequence
catagattaatgccgctgcac

SEQ ID NO: 243272 - DNA, 21 bp, Artificial sequence
  SiRNA target sequence
atagattaatgccgctgcaca

SEQ ID NO: 243273 - DNA, 21 bp, Artificial sequence
  SiRNA target sequence
tagattaatgccgctgcacac

SEQ ID NO: 243274 - DNA, 21 bp, Artificial sequence
  SiRNA target sequence
agattaatgccgctgcacaca

SEQ ID NO: 243275 - DNA, 21 bp, Artificial sequence
  SiRNA target sequence
gattaatgccgctgcacacat

SEQ ID NO: 243276 - DNA, 21 bp, Artificial sequence
  SiRNA target sequence
attaatgccgctgcacacata

SEQ ID NO: 243277 - DNA, 21 bp, Artificial sequence
  SiRNA target sequence
ttaatgccgctgcacacatat

SEQ ID NO: 243278 - DNA, 21 bp, Artificial sequence
  SiRNA target sequence
taatgccgctgcacacatatt

SEQ ID NO: 243279 - DNA, 21 bp, Artificial sequence
  SiRNA target sequence
aatgccgctgcacacatattt

SEQ ID NO: 243280 - DNA, 21 bp, Artificial sequence
  SiRNA target sequence
atgccgctgcacacatatttc

SEQ ID NO: 243281 - DNA, 21 bp, Artificial sequence
  SiRNA target sequence
tgccgctgcacacatatttct

SEQ ID NO: 243282 - DNA, 21 bp, Artificial sequence
  SiRNA target sequence
gccgctgcacacatatttctt

SEQ ID NO: 243283 - DNA, 21 bp, Artificial sequence
  SiRNA target sequence
ccgctgcacacatatttctta

SEQ ID NO: 243284 - DNA, 21 bp, Artificial sequence
  SiRNA target sequence
cgctgcacacatatttcttaa

SEQ ID NO: 243285 - DNA, 21 bp, Artificial sequence
  SiRNA target sequence
gctgcacacatatttcttaaa

SEQ ID NO: 243286 - DNA, 21 bp, Artificial sequence
  SiRNA target sequence
ctgcacacatatttcttaaaa

SEQ ID NO: 243287 - DNA, 21 bp, Artificial sequence
  SiRNA target sequence
tgcacacatatttcttaaaaa

SEQ ID NO: 243288 - DNA, 21 bp, Artificial sequence
  SiRNA target sequence
gcacacatatttcttaaaaat

SEQ ID NO: 243289 - DNA, 21 bp, Artificial sequence
  SiRNA target sequence
cacacatatttcttaaaaatt

SEQ ID NO: 243290 - DNA, 21 bp, Artificial sequence
  SiRNA target sequence
acacatatttcttaaaaattt

SEQ ID NO: 243291 - DNA, 21 bp, Artificial sequence
  SiRNA target sequence
cacatatttcttaaaaatttg

SEQ ID NO: 243292 - DNA, 21 bp, Artificial sequence
  SiRNA target sequence
acatatttcttaaaaatttgg

SEQ ID NO: 243293 - DNA, 21 bp, Artificial sequence
  SiRNA target sequence
catatttcttaaaaatttgga

SEQ ID NO: 243294 - DNA, 21 bp, Artificial sequence
  SiRNA target sequence
atatttcttaaaaatttggat

SEQ ID NO: 243295 - DNA, 21 bp, Artificial sequence
  SiRNA target sequence
tatttcttaaaaatttggatt

SEQ ID NO: 243296 - DNA, 21 bp, Artificial sequence
  SiRNA target sequence
atttcttaaaaatttggattg

SEQ ID NO: 243297 - DNA, 21 bp, Artificial sequence
  SiRNA target sequence
tttcttaaaaatttggattgt

SEQ ID NO: 243298 - DNA, 21 bp, Artificial sequence
  SiRNA target sequence
ttcttaaaaatttggattgta

SEQ ID NO: 243299 - DNA, 21 bp, Artificial sequence
  SiRNA target sequence
tcttaaaaatttggattgtaa

SEQ ID NO: 243300 - DNA, 21 bp, Artificial sequence
  SiRNA target sequence
cttaaaaatttggattgtaaa

SEQ ID NO: 243301 - DNA, 21 bp, Artificial sequence
  SiRNA target sequence
ttaaaaatttggattgtaaaa

SEQ ID NO: 243302 - DNA, 21 bp, Artificial sequence
  SiRNA target sequence
taaaaatttggattgtaaaag

SEQ ID NO: 243303 - DNA, 21 bp, Artificial sequence
  SiRNA target sequence
aaaaatttggattgtaaaaga

SEQ ID NO: 243304 - DNA, 21 bp, Artificial sequence
  SiRNA target sequence
aaaatttggattgtaaaagat

SEQ ID NO: 243305 - DNA, 21 bp, Artificial sequence
  SiRNA target sequence
aaatttggattgtaaaagatc

SEQ ID NO: 243306 - DNA, 21 bp, Artificial sequence
  SiRNA target sequence
aatttggattgtaaaagatca

SEQ ID NO: 243307 - DNA, 21 bp, Artificial sequence
  SiRNA target sequence
atttggattgtaaaagatcaa

SEQ ID NO: 243308 - DNA, 21 bp, Artificial sequence
  SiRNA target sequence
tttggattgtaaaagatcaaa

SEQ ID NO: 243309 - DNA, 21 bp, Artificial sequence
  SiRNA target sequence
ttggattgtaaaagatcaaac

SEQ ID NO: 243310 - DNA, 21 bp, Artificial sequence
  SiRNA target sequence
tggattgtaaaagatcaaacg

SEQ ID NO: 243311 - DNA, 21 bp, Artificial sequence
  SiRNA target sequence
ggattgtaaaagatcaaacga

SEQ ID NO: 243312 - DNA, 21 bp, Artificial sequence
  SiRNA target sequence
gattgtaaaagatcaaacgag

SEQ ID NO: 243313 - DNA, 21 bp, Artificial sequence
  SiRNA target sequence
attgtaaaagatcaaacgagg

SEQ ID NO: 243314 - DNA, 21 bp, Artificial sequence
  SiRNA target sequence
ttgtaaaagatcaaacgagga

SEQ ID NO: 243315 - DNA, 21 bp, Artificial sequence
  SiRNA target sequence
tgtaaaagatcaaacgaggat

SEQ ID NO: 243316 - DNA, 21 bp, Artificial sequence
  SiRNA target sequence
gtaaaagatcaaacgaggatg

SEQ ID NO: 243317 - DNA, 21 bp, Artificial sequence
  SiRNA target sequence
taaaagatcaaacgaggatgt

SEQ ID NO: 243318 - DNA, 21 bp, Artificial sequence
  SiRNA target sequence
aaaagatcaaacgaggatgtc

SEQ ID NO: 243319 - DNA, 21 bp, Artificial sequence
  SiRNA target sequence
aaagatcaaacgaggatgtcg

SEQ ID NO: 243320 - DNA, 21 bp, Artificial sequence
  SiRNA target sequence
aagatcaaacgaggatgtcgt

SEQ ID NO: 243321 - DNA, 21 bp, Artificial sequence
  SiRNA target sequence
agatcaaacgaggatgtcgtt

SEQ ID NO: 243322 - DNA, 21 bp, Artificial sequence
  SiRNA target sequence
gatcaaacgaggatgtcgttt

SEQ ID NO: 243323 - DNA, 21 bp, Artificial sequence
  SiRNA target sequence
atcaaacgaggatgtcgtttt

SEQ ID NO: 243324 - DNA, 21 bp, Artificial sequence
  SiRNA target sequence
tcaaacgaggatgtcgttttg

SEQ ID NO: 243325 - DNA, 21 bp, Artificial sequence
  SiRNA target sequence
caaacgaggatgtcgttttgt

SEQ ID NO: 243326 - DNA, 21 bp, Artificial sequence
  SiRNA target sequence
aaacgaggatgtcgttttgtc

SEQ ID NO: 243327 - DNA, 21 bp, Artificial sequence
  SiRNA target sequence
aacgaggatgtcgttttgtct

SEQ ID NO: 243328 - DNA, 21 bp, Artificial sequence
  SiRNA target sequence
acgaggatgtcgttttgtctt

SEQ ID NO: 243329 - DNA, 21 bp, Artificial sequence
  SiRNA target sequence
cgaggatgtcgttttgtcttc

SEQ ID NO: 243330 - DNA, 21 bp, Artificial sequence
  SiRNA target sequence
gaggatgtcgttttgtcttct

SEQ ID NO: 243331 - DNA, 21 bp, Artificial sequence
  SiRNA target sequence
aggatgtcgttttgtcttctt

SEQ ID NO: 243332 - DNA, 21 bp, Artificial sequence
  SiRNA target sequence
ggatgtcgttttgtcttcttc

SEQ ID NO: 243333 - DNA, 21 bp, Artificial sequence
  SiRNA target sequence
gatgtcgttttgtcttcttct

SEQ ID NO: 243334 - DNA, 21 bp, Artificial sequence
  SiRNA target sequence
atgtcgttttgtcttcttctt

SEQ ID NO: 243335 - DNA, 21 bp, Artificial sequence
  SiRNA target sequence
tgtcgttttgtcttcttcttt

SEQ ID NO: 243336 - DNA, 21 bp, Artificial sequence
  SiRNA target sequence
gtcgttttgtcttcttcttta

SEQ ID NO: 243337 - DNA, 21 bp, Artificial sequence
  SiRNA target sequence
tcgttttgtcttcttctttat

SEQ ID NO: 243338 - DNA, 21 bp, Artificial sequence
  SiRNA target sequence
cgttttgtcttcttctttatt

SEQ ID NO: 243339 - DNA, 21 bp, Artificial sequence
  SiRNA target sequence
gttttgtcttcttctttattt

SEQ ID NO: 243340 - DNA, 21 bp, Artificial sequence
  SiRNA target sequence
ttttgtcttcttctttattta

SEQ ID NO: 243341 - DNA, 21 bp, Artificial sequence
  SiRNA target sequence
tttgtcttcttctttatttat

SEQ ID NO: 243342 - DNA, 21 bp, Artificial sequence
  SiRNA target sequence
ttgtcttcttctttatttata

SEQ ID NO: 243343 - DNA, 21 bp, Artificial sequence
  SiRNA target sequence
tgtcttcttctttatttatag

SEQ ID NO: 243344 - DNA, 21 bp, Artificial sequence
  SiRNA target sequence
gtcttcttctttatttatagt

SEQ ID NO: 243345 - DNA, 21 bp, Artificial sequence
  SiRNA target sequence
tcttcttctttatttatagtt

SEQ ID NO: 243346 - DNA, 21 bp, Artificial sequence
  SiRNA target sequence
cttcttctttatttatagttt

SEQ ID NO: 243347 - DNA, 21 bp, Artificial sequence
  SiRNA target sequence
ttcttctttatttatagtttc

SEQ ID NO: 243348 - DNA, 21 bp, Artificial sequence
  SiRNA target sequence
tcttctttatttatagtttcc

SEQ ID NO: 243349 - DNA, 21 bp, Artificial sequence
  SiRNA target sequence
cttctttatttatagtttcct

SEQ ID NO: 243350 - DNA, 21 bp, Artificial sequence
  SiRNA target sequence
ttctttatttatagtttcctt

SEQ ID NO: 243351 - DNA, 21 bp, Artificial sequence
  SiRNA target sequence
tctttatttatagtttccttt

SEQ ID NO: 243352 - DNA, 21 bp, Artificial sequence
  SiRNA target sequence
ctttatttatagtttccttta

SEQ ID NO: 243353 - DNA, 21 bp, Artificial sequence
  SiRNA target sequence
tttatttatagtttcctttat

SEQ ID NO: 243354 - DNA, 21 bp, Artificial sequence
  SiRNA target sequence
ttatttatagtttcctttatt

SEQ ID NO: 243355 - DNA, 21 bp, Artificial sequence
  SiRNA target sequence
tatttatagtttcctttattt

SEQ ID NO: 243356 - DNA, 21 bp, Artificial sequence
  SiRNA target sequence
atttatagtttcctttatttc

SEQ ID NO: 243357 - DNA, 21 bp, Artificial sequence
  SiRNA target sequence
tttatagtttcctttatttct

SEQ ID NO: 243358 - DNA, 21 bp, Artificial sequence
  SiRNA target sequence
ttatagtttcctttatttctt

SEQ ID NO: 243359 - DNA, 21 bp, Artificial sequence
  SiRNA target sequence
tatagtttcctttatttcttt

SEQ ID NO: 243360 - DNA, 21 bp, Artificial sequence
  SiRNA target sequence
atagtttcctttatttcttta

SEQ ID NO: 243361 - DNA, 21 bp, Artificial sequence
  SiRNA target sequence
tagtttcctttatttctttag

SEQ ID NO: 243362 - DNA, 21 bp, Artificial sequence
  SiRNA target sequence
agtttcctttatttctttagt

SEQ ID NO: 243363 - DNA, 21 bp, Artificial sequence
  SiRNA target sequence
gtttcctttatttctttagtt

SEQ ID NO: 243364 - DNA, 21 bp, Artificial sequence
  SiRNA target sequence
tttcctttatttctttagttt

SEQ ID NO: 243365 - DNA, 21 bp, Artificial sequence
  SiRNA target sequence
ttcctttatttctttagtttt

SEQ ID NO: 243366 - DNA, 21 bp, Artificial sequence
  SiRNA target sequence
tcctttatttctttagtttta

SEQ ID NO: 243367 - DNA, 21 bp, Artificial sequence
  SiRNA target sequence
cctttatttctttagttttaa

SEQ ID NO: 243368 - DNA, 21 bp, Artificial sequence
  SiRNA target sequence
ctttatttctttagttttaag

SEQ ID NO: 243369 - DNA, 21 bp, Artificial sequence
  SiRNA target sequence
tttatttctttagttttaaga

SEQ ID NO: 243370 - DNA, 21 bp, Artificial sequence
  SiRNA target sequence
ttatttctttagttttaagag

SEQ ID NO: 243371 - DNA, 21 bp, Artificial sequence
  SiRNA target sequence
tatttctttagttttaagagg

SEQ ID NO: 243372 - DNA, 21 bp, Artificial sequence
  SiRNA target sequence
atttctttagttttaagagga

SEQ ID NO: 243373 - DNA, 21 bp, Artificial sequence
  SiRNA target sequence
tttctttagttttaagaggaa

SEQ ID NO: 243374 - DNA, 21 bp, Artificial sequence
  SiRNA target sequence
ttctttagttttaagaggaat

SEQ ID NO: 243375 - DNA, 21 bp, Artificial sequence
  SiRNA target sequence
tctttagttttaagaggaata

SEQ ID NO: 243376 - DNA, 21 bp, Artificial sequence
  SiRNA target sequence
ctttagttttaagaggaatat

SEQ ID NO: 243377 - DNA, 21 bp, Artificial sequence
  SiRNA target sequence
tttagttttaagaggaatata

SEQ ID NO: 243378 - DNA, 21 bp, Artificial sequence
  SiRNA target sequence
ttagttttaagaggaatataa

SEQ ID NO: 243379 - DNA, 21 bp, Artificial sequence
  SiRNA target sequence
tagttttaagaggaatataac

SEQ ID NO: 243380 - DNA, 21 bp, Artificial sequence
  SiRNA target sequence
agttttaagaggaatataact

SEQ ID NO: 243381 - DNA, 21 bp, Artificial sequence
  SiRNA target sequence
gttttaagaggaatataactt

SEQ ID NO: 243382 - DNA, 21 bp, Artificial sequence
  SiRNA target sequence
ttttaagaggaatataacttt

SEQ ID NO: 243383 - DNA, 21 bp, Artificial sequence
  SiRNA target sequence
tttaagaggaatataactttt

SEQ ID NO: 243384 - DNA, 21 bp, Artificial sequence
  SiRNA target sequence
ttaagaggaatataacttttt

SEQ ID NO: 243385 - DNA, 21 bp, Artificial sequence
  SiRNA target sequence
taagaggaatataacttttta

SEQ ID NO: 243386 - DNA, 21 bp, Artificial sequence
  SiRNA target sequence
aagaggaatataactttttaa

SEQ ID NO: 243387 - DNA, 21 bp, Artificial sequence
  SiRNA target sequence
agaggaatataactttttaaa

SEQ ID NO: 243388 - DNA, 21 bp, Artificial sequence
  SiRNA target sequence
gaggaatataactttttaaaa

SEQ ID NO: 243389 - DNA, 21 bp, Artificial sequence
  SiRNA target sequence
aggaatataactttttaaaaa

SEQ ID NO: 243390 - DNA, 21 bp, Artificial sequence
  SiRNA target sequence
ggaatataactttttaaaaag

SEQ ID NO: 243391 - DNA, 21 bp, Artificial sequence
  SiRNA target sequence
gaatataactttttaaaaagt

SEQ ID NO: 243392 - DNA, 21 bp, Artificial sequence
  SiRNA target sequence
aatataactttttaaaaagta

SEQ ID NO: 243393 - DNA, 21 bp, Artificial sequence
  SiRNA target sequence
atataactttttaaaaagtaa

SEQ ID NO: 243394 - DNA, 21 bp, Artificial sequence
  SiRNA target sequence
tataactttttaaaaagtaaa

SEQ ID NO: 243395 - DNA, 21 bp, Artificial sequence
  SiRNA target sequence
ataactttttaaaaagtaaat

SEQ ID NO: 243396 - DNA, 21 bp, Artificial sequence
  SiRNA target sequence
taactttttaaaaagtaaatt

SEQ ID NO: 243397 - DNA, 21 bp, Artificial sequence
  SiRNA target sequence
aactttttaaaaagtaaatta

SEQ ID NO: 243398 - DNA, 21 bp, Artificial sequence
  SiRNA target sequence
actttttaaaaagtaaattaa

SEQ ID NO: 243399 - DNA, 21 bp, Artificial sequence
  SiRNA target sequence
ctttttaaaaagtaaattaat

SEQ ID NO: 243400 - DNA, 21 bp, Artificial sequence
  SiRNA target sequence
tttttaaaaagtaaattaatg

SEQ ID NO: 243401 - DNA, 21 bp, Artificial sequence
  SiRNA target sequence
ttttaaaaagtaaattaatgt

SEQ ID NO: 243402 - DNA, 21 bp, Artificial sequence
  SiRNA target sequence
tttaaaaagtaaattaatgta

SEQ ID NO: 243403 - DNA, 21 bp, Artificial sequence
  SiRNA target sequence
ttaaaaagtaaattaatgtag

SEQ ID NO: 243404 - DNA, 21 bp, Artificial sequence
  SiRNA target sequence
taaaaagtaaattaatgtagt

SEQ ID NO: 243405 - DNA, 21 bp, Artificial sequence
  SiRNA target sequence
aaaaagtaaattaatgtagtt

SEQ ID NO: 243406 - DNA, 21 bp, Artificial sequence
  SiRNA target sequence
aaaagtaaattaatgtagtta

SEQ ID NO: 243407 - DNA, 21 bp, Artificial sequence
  SiRNA target sequence
aaagtaaattaatgtagttac

SEQ ID NO: 243408 - DNA, 21 bp, Artificial sequence
  SiRNA target sequence
aagtaaattaatgtagttaca

SEQ ID NO: 243409 - DNA, 21 bp, Artificial sequence
  SiRNA target sequence
agtaaattaatgtagttacaa

SEQ ID NO: 243410 - DNA, 21 bp, Artificial sequence
  SiRNA target sequence
gtaaattaatgtagttacaaa

SEQ ID NO: 243411 - DNA, 21 bp, Artificial sequence
  SiRNA target sequence
taaattaatgtagttacaaaa

SEQ ID NO: 243412 - DNA, 21 bp, Artificial sequence
  SiRNA target sequence
aaattaatgtagttacaaaag

SEQ ID NO: 243413 - DNA, 21 bp, Artificial sequence
  SiRNA target sequence
aattaatgtagttacaaaaga

SEQ ID NO: 243414 - DNA, 21 bp, Artificial sequence
  SiRNA target sequence
attaatgtagttacaaaagac

SEQ ID NO: 243415 - DNA, 21 bp, Artificial sequence
  SiRNA target sequence
ttaatgtagttacaaaagaca

SEQ ID NO: 243416 - DNA, 21 bp, Artificial sequence
  SiRNA target sequence
taatgtagttacaaaagacaa

SEQ ID NO: 243417 - DNA, 21 bp, Artificial sequence
  SiRNA target sequence
aatgtagttacaaaagacaag

SEQ ID NO: 243418 - DNA, 21 bp, Artificial sequence
  SiRNA target sequence
atgtagttacaaaagacaaga

SEQ ID NO: 243419 - DNA, 21 bp, Artificial sequence
  SiRNA target sequence
tgtagttacaaaagacaagat

SEQ ID NO: 243420 - DNA, 21 bp, Artificial sequence
  SiRNA target sequence
gtagttacaaaagacaagatc

SEQ ID NO: 243421 - DNA, 21 bp, Artificial sequence
  SiRNA target sequence
tagttacaaaagacaagatca

SEQ ID NO: 243422 - DNA, 21 bp, Artificial sequence
  SiRNA target sequence
agttacaaaagacaagatcaa

SEQ ID NO: 243423 - DNA, 21 bp, Artificial sequence
  SiRNA target sequence
gttacaaaagacaagatcaaa

SEQ ID NO: 243424 - DNA, 21 bp, Artificial sequence
  SiRNA target sequence
ttacaaaagacaagatcaaaa

SEQ ID NO: 243425 - DNA, 21 bp, Artificial sequence
  SiRNA target sequence
tacaaaagacaagatcaaaaa

SEQ ID NO: 243426 - DNA, 21 bp, Artificial sequence
  SiRNA target sequence
acaaaagacaagatcaaaaaa

SEQ ID NO: 243427 - DNA, 21 bp, Artificial sequence
  SiRNA target sequence
caaaagacaagatcaaaaaaa

SEQ ID NO: 243428 - DNA, 21 bp, Artificial sequence
  SiRNA target sequence
aaaagacaagatcaaaaaaaa

SEQ ID NO: 243429 - DNA, 21 bp, Artificial sequence
  SiRNA target sequence
aaagacaagatcaaaaaaaac

SEQ ID NO: 243430 - DNA, 21 bp, Artificial sequence
  SiRNA target sequence
aagacaagatcaaaaaaaaca

SEQ ID NO: 243431 - DNA, 21 bp, Artificial sequence
  SiRNA target sequence
agacaagatcaaaaaaaacaa

SEQ ID NO: 243432 - DNA, 21 bp, Artificial sequence
  SiRNA target sequence
gacaagatcaaaaaaaacaaa

SEQ ID NO: 243433 - DNA, 21 bp, Artificial sequence
  SiRNA target sequence
acaagatcaaaaaaaacaaac

SEQ ID NO: 243434 - DNA, 21 bp, Artificial sequence
  SiRNA target sequence
caagatcaaaaaaaacaaact

SEQ ID NO: 243435 - DNA, 21 bp, Artificial sequence
  SiRNA target sequence
aagatcaaaaaaaacaaacta

SEQ ID NO: 243436 - DNA, 21 bp, Artificial sequence
  SiRNA target sequence
agatcaaaaaaaacaaactac

SEQ ID NO: 243437 - DNA, 21 bp, Artificial sequence
  SiRNA target sequence
gatcaaaaaaaacaaactact

SEQ ID NO: 243438 - DNA, 21 bp, Artificial sequence
  SiRNA target sequence
atcaaaaaaaacaaactacta

SEQ ID NO: 243439 - DNA, 21 bp, Artificial sequence
  SiRNA target sequence
tcaaaaaaaacaaactactac

SEQ ID NO: 243440 - DNA, 21 bp, Artificial sequence
  SiRNA target sequence
caaaaaaaacaaactactacc

SEQ ID NO: 243441 - DNA, 21 bp, Artificial sequence
  SiRNA target sequence
aaaaaaaacaaactactaccg

SEQ ID NO: 243442 - DNA, 21 bp, Artificial sequence
  SiRNA target sequence
aaaaaaacaaactactaccgt

SEQ ID NO: 243443 - DNA, 21 bp, Artificial sequence
  SiRNA target sequence
aaaaaacaaactactaccgtc

SEQ ID NO: 243444 - DNA, 21 bp, Artificial sequence
  SiRNA target sequence
aaaaacaaactactaccgtca

SEQ ID NO: 243445 - DNA, 21 bp, Artificial sequence
  SiRNA target sequence
aaaacaaactactaccgtcaa

SEQ ID NO: 243446 - DNA, 21 bp, Artificial sequence
  SiRNA target sequence
aaacaaactactaccgtcaat

SEQ ID NO: 243447 - DNA, 21 bp, Artificial sequence
  SiRNA target sequence
aacaaactactaccgtcaatt

SEQ ID NO: 243448 - DNA, 21 bp, Artificial sequence
  SiRNA target sequence
acaaactactaccgtcaattt

SEQ ID NO: 243449 - DNA, 21 bp, Artificial sequence
  SiRNA target sequence
caaactactaccgtcaatttt

SEQ ID NO: 243450 - DNA, 21 bp, Artificial sequence
  SiRNA target sequence
aaactactaccgtcaatttta

SEQ ID NO: 243451 - DNA, 21 bp, Artificial sequence
  SiRNA target sequence
aactactaccgtcaattttat

SEQ ID NO: 243452 - DNA, 21 bp, Artificial sequence
  SiRNA target sequence
actactaccgtcaattttatc

SEQ ID NO: 243453 - DNA, 21 bp, Artificial sequence
  SiRNA target sequence
ctactaccgtcaattttatca

SEQ ID NO: 243454 - DNA, 21 bp, Artificial sequence
  SiRNA target sequence
tactaccgtcaattttatcat

SEQ ID NO: 243455 - DNA, 21 bp, Artificial sequence
  SiRNA target sequence
actaccgtcaattttatcatg

SEQ ID NO: 243456 - DNA, 21 bp, Artificial sequence
  SiRNA target sequence
ctaccgtcaattttatcatgc

SEQ ID NO: 243457 - DNA, 21 bp, Artificial sequence
  SiRNA target sequence
taccgtcaattttatcatgca

SEQ ID NO: 243458 - DNA, 21 bp, Artificial sequence
  SiRNA target sequence
accgtcaattttatcatgcaa

SEQ ID NO: 243459 - DNA, 21 bp, Artificial sequence
  SiRNA target sequence
ccgtcaattttatcatgcaaa

SEQ ID NO: 243460 - DNA, 21 bp, Artificial sequence
  SiRNA target sequence
cgtcaattttatcatgcaaac

SEQ ID NO: 243461 - DNA, 21 bp, Artificial sequence
  SiRNA target sequence
gtcaattttatcatgcaaacc

SEQ ID NO: 243462 - DNA, 21 bp, Artificial sequence
  SiRNA target sequence
tcaattttatcatgcaaacct

SEQ ID NO: 243463 - DNA, 21 bp, Artificial sequence
  SiRNA target sequence
caattttatcatgcaaacctg

SEQ ID NO: 243464 - DNA, 21 bp, Artificial sequence
  SiRNA target sequence
aattttatcatgcaaacctgc

SEQ ID NO: 243465 - DNA, 21 bp, Artificial sequence
  SiRNA target sequence
attttatcatgcaaacctgca

SEQ ID NO: 243466 - DNA, 21 bp, Artificial sequence
  SiRNA target sequence
ttttatcatgcaaacctgcag

SEQ ID NO: 243467 - DNA, 21 bp, Artificial sequence
  SiRNA target sequence
tttatcatgcaaacctgcagg

SEQ ID NO: 243468 - DNA, 21 bp, Artificial sequence
  SiRNA target sequence
ttatcatgcaaacctgcagga

SEQ ID NO: 243469 - DNA, 21 bp, Artificial sequence
  SiRNA target sequence
tatcatgcaaacctgcaggaa

SEQ ID NO: 243470 - DNA, 21 bp, Artificial sequence
  SiRNA target sequence
atcatgcaaacctgcaggaag

SEQ ID NO: 243471 - DNA, 21 bp, Artificial sequence
  SiRNA target sequence
tcatgcaaacctgcaggaagt

SEQ ID NO: 243472 - DNA, 21 bp, Artificial sequence
  SiRNA target sequence
catgcaaacctgcaggaagta

SEQ ID NO: 243473 - DNA, 21 bp, Artificial sequence
  SiRNA target sequence
atgcaaacctgcaggaagtat

SEQ ID NO: 243474 - DNA, 21 bp, Artificial sequence
  SiRNA target sequence
tgcaaacctgcaggaagtata

SEQ ID NO: 243475 - DNA, 21 bp, Artificial sequence
  SiRNA target sequence
gcaaacctgcaggaagtatat

SEQ ID NO: 243476 - DNA, 21 bp, Artificial sequence
  SiRNA target sequence
caaacctgcaggaagtatatt

SEQ ID NO: 243477 - DNA, 21 bp, Artificial sequence
  SiRNA target sequence
aaacctgcaggaagtatattt

SEQ ID NO: 243478 - DNA, 21 bp, Artificial sequence
  SiRNA target sequence
aacctgcaggaagtatatttg

SEQ ID NO: 243479 - DNA, 21 bp, Artificial sequence
  SiRNA target sequence
acctgcaggaagtatatttgc

SEQ ID NO: 243480 - DNA, 21 bp, Artificial sequence
  SiRNA target sequence
cctgcaggaagtatatttgct

SEQ ID NO: 243481 - DNA, 21 bp, Artificial sequence
  SiRNA target sequence
ctgcaggaagtatatttgcta

SEQ ID NO: 243482 - DNA, 21 bp, Artificial sequence
  SiRNA target sequence
tgcaggaagtatatttgctaa

SEQ ID NO: 243483 - DNA, 21 bp, Artificial sequence
  SiRNA target sequence
gcaggaagtatatttgctaat

SEQ ID NO: 243484 - DNA, 21 bp, Artificial sequence
  SiRNA target sequence
caggaagtatatttgctaatt

SEQ ID NO: 243485 - DNA, 21 bp, Artificial sequence
  SiRNA target sequence
aggaagtatatttgctaattc

SEQ ID NO: 243486 - DNA, 21 bp, Artificial sequence
  SiRNA target sequence
ggaagtatatttgctaattca

SEQ ID NO: 243487 - DNA, 21 bp, Artificial sequence
  SiRNA target sequence
gaagtatatttgctaattcat

SEQ ID NO: 243488 - DNA, 21 bp, Artificial sequence
  SiRNA target sequence
aagtatatttgctaattcatc

SEQ ID NO: 243489 - DNA, 21 bp, Artificial sequence
  SiRNA target sequence
agtatatttgctaattcatct

SEQ ID NO: 243490 - DNA, 21 bp, Artificial sequence
  SiRNA target sequence
gtatatttgctaattcatctt

SEQ ID NO: 243491 - DNA, 21 bp, Artificial sequence
  SiRNA target sequence
tatatttgctaattcatcttt

SEQ ID NO: 243492 - DNA, 21 bp, Artificial sequence
  SiRNA target sequence
atatttgctaattcatctttt

SEQ ID NO: 243493 - DNA, 21 bp, Artificial sequence
  SiRNA target sequence
tatttgctaattcatctttta

SEQ ID NO: 243494 - DNA, 21 bp, Artificial sequence
  SiRNA target sequence
atttgctaattcatcttttat

SEQ ID NO: 243495 - DNA, 21 bp, Artificial sequence
  SiRNA target sequence
tttgctaattcatcttttata

SEQ ID NO: 243496 - DNA, 21 bp, Artificial sequence
  SiRNA target sequence
ttgctaattcatcttttatat

SEQ ID NO: 243497 - DNA, 21 bp, Artificial sequence
  SiRNA target sequence
tgctaattcatcttttatata

SEQ ID NO: 243498 - DNA, 21 bp, Artificial sequence
  SiRNA target sequence
gctaattcatcttttatataa

SEQ ID NO: 243499 - DNA, 21 bp, Artificial sequence
  SiRNA target sequence
ctaattcatcttttatataaa

SEQ ID NO: 243500 - DNA, 21 bp, Artificial sequence
  SiRNA target sequence
taattcatcttttatataaat

SEQ ID NO: 243501 - DNA, 21 bp, Artificial sequence
  SiRNA target sequence
aattcatcttttatataaata

SEQ ID NO: 243502 - DNA, 21 bp, Artificial sequence
  SiRNA target sequence
attcatcttttatataaataa

SEQ ID NO: 243503 - DNA, 21 bp, Artificial sequence
  SiRNA target sequence
ttcatcttttatataaataaa

SEQ ID NO: 243504 - DNA, 21 bp, Artificial sequence
  SiRNA target sequence
tcatcttttatataaataaaa

SEQ ID NO: 243505 - DNA, 21 bp, Artificial sequence
  SiRNA target sequence
catcttttatataaataaaag

SEQ ID NO: 243506 - DNA, 21 bp, Artificial sequence
  SiRNA target sequence
atcttttatataaataaaagc

SEQ ID NO: 243507 - DNA, 21 bp, Artificial sequence
  SiRNA target sequence
tcttttatataaataaaagct

SEQ ID NO: 243508 - DNA, 21 bp, Artificial sequence
  SiRNA target sequence
cttttatataaataaaagcta

SEQ ID NO: 243509 - DNA, 21 bp, Artificial sequence
  SiRNA target sequence
ttttatataaataaaagctac

SEQ ID NO: 243510 - DNA, 21 bp, Artificial sequence
  SiRNA target sequence
tttatataaataaaagctaca

SEQ ID NO: 243511 - DNA, 21 bp, Artificial sequence
  SiRNA target sequence
ttatataaataaaagctacag

SEQ ID NO: 243512 - DNA, 21 bp, Artificial sequence
  SiRNA target sequence
tatataaataaaagctacaga

SEQ ID NO: 243513 - DNA, 21 bp, Artificial sequence
  SiRNA target sequence
atataaataaaagctacagaa

SEQ ID NO: 243514 - DNA, 21 bp, Artificial sequence
  SiRNA target sequence
tataaataaaagctacagaaa

SEQ ID NO: 243515 - DNA, 21 bp, Artificial sequence
  SiRNA target sequence
ataaataaaagctacagaaat

SEQ ID NO: 243516 - DNA, 21 bp, Artificial sequence
  SiRNA target sequence
taaataaaagctacagaaata

SEQ ID NO: 243517 - DNA, 21 bp, Artificial sequence
  SiRNA target sequence
aaataaaagctacagaaataa

SEQ ID NO: 243518 - DNA, 21 bp, Artificial sequence
  SiRNA target sequence
aataaaagctacagaaataat

SEQ ID NO: 243519 - DNA, 21 bp, Artificial sequence
  SiRNA target sequence
ataaaagctacagaaataatc

SEQ ID NO: 243520 - DNA, 21 bp, Artificial sequence
  SiRNA target sequence
taaaagctacagaaataatca

SEQ ID NO: 243521 - DNA, 21 bp, Artificial sequence
  SiRNA target sequence
aaaagctacagaaataatcat

SEQ ID NO: 243522 - DNA, 21 bp, Artificial sequence
  SiRNA target sequence
aaagctacagaaataatcatt

SEQ ID NO: 243523 - DNA, 21 bp, Artificial sequence
  SiRNA target sequence
aagctacagaaataatcattg

SEQ ID NO: 243524 - DNA, 21 bp, Artificial sequence
  SiRNA target sequence
agctacagaaataatcattga

SEQ ID NO: 243525 - DNA, 21 bp, Artificial sequence
  SiRNA target sequence
gctacagaaataatcattgaa

SEQ ID NO: 243526 - DNA, 21 bp, Artificial sequence
  SiRNA target sequence
ctacagaaataatcattgaaa

SEQ ID NO: 243527 - DNA, 21 bp, Artificial sequence
  SiRNA target sequence
tacagaaataatcattgaaat

SEQ ID NO: 243528 - DNA, 21 bp, Artificial sequence
  SiRNA target sequence
acagaaataatcattgaaatg

SEQ ID NO: 243529 - DNA, 21 bp, Artificial sequence
  SiRNA target sequence
cagaaataatcattgaaatgg

SEQ ID NO: 243530 - DNA, 21 bp, Artificial sequence
  SiRNA target sequence
agaaataatcattgaaatggc

SEQ ID NO: 243531 - DNA, 21 bp, Artificial sequence
  SiRNA target sequence
gaaataatcattgaaatggcg

SEQ ID NO: 243532 - DNA, 21 bp, Artificial sequence
  SiRNA target sequence
aaataatcattgaaatggcgg

SEQ ID NO: 243533 - DNA, 21 bp, Artificial sequence
  SiRNA target sequence
aataatcattgaaatggcggt

SEQ ID NO: 243534 - DNA, 21 bp, Artificial sequence
  SiRNA target sequence
ataatcattgaaatggcggtg

SEQ ID NO: 243535 - DNA, 21 bp, Artificial sequence
  SiRNA target sequence
taatcattgaaatggcggtga

SEQ ID NO: 243536 - DNA, 21 bp, Artificial sequence
  SiRNA target sequence
aatcattgaaatggcggtgat

SEQ ID NO: 243537 - DNA, 21 bp, Artificial sequence
  SiRNA target sequence
atcattgaaatggcggtgatt

SEQ ID NO: 243538 - DNA, 21 bp, Artificial sequence
  SiRNA target sequence
tcattgaaatggcggtgattg

SEQ ID NO: 243539 - DNA, 21 bp, Artificial sequence
  SiRNA target sequence
cattgaaatggcggtgattgt

SEQ ID NO: 243540 - DNA, 21 bp, Artificial sequence
  SiRNA target sequence
attgaaatggcggtgattgtg

SEQ ID NO: 243541 - DNA, 21 bp, Artificial sequence
  SiRNA target sequence
ttgaaatggcggtgattgtgg

SEQ ID NO: 243542 - DNA, 21 bp, Artificial sequence
  SiRNA target sequence
tgaaatggcggtgattgtgga

SEQ ID NO: 243543 - DNA, 21 bp, Artificial sequence
  SiRNA target sequence
gaaatggcggtgattgtggaa

SEQ ID NO: 243544 - DNA, 21 bp, Artificial sequence
  SiRNA target sequence
aaatggcggtgattgtggaaa

SEQ ID NO: 243545 - DNA, 21 bp, Artificial sequence
  SiRNA target sequence
aatggcggtgattgtggaaaa

SEQ ID NO: 243546 - DNA, 21 bp, Artificial sequence
  SiRNA target sequence
atggcggtgattgtggaaaaa

SEQ ID NO: 243547 - DNA, 21 bp, Artificial sequence
  SiRNA target sequence
tggcggtgattgtggaaaaat

SEQ ID NO: 243548 - DNA, 21 bp, Artificial sequence
  SiRNA target sequence
ggcggtgattgtggaaaaatt

SEQ ID NO: 243549 - DNA, 21 bp, Artificial sequence
  SiRNA target sequence
gcggtgattgtggaaaaatta

SEQ ID NO: 243550 - DNA, 21 bp, Artificial sequence
  SiRNA target sequence
cggtgattgtggaaaaattag

SEQ ID NO: 243551 - DNA, 21 bp, Artificial sequence
  SiRNA target sequence
ggtgattgtggaaaaattagg

SEQ ID NO: 243552 - DNA, 21 bp, Artificial sequence
  SiRNA target sequence
gtgattgtggaaaaattagga

SEQ ID NO: 243553 - DNA, 21 bp, Artificial sequence
  SiRNA target sequence
tgattgtggaaaaattaggaa

SEQ ID NO: 243554 - DNA, 21 bp, Artificial sequence
  SiRNA target sequence
gattgtggaaaaattaggaac

SEQ ID NO: 243555 - DNA, 21 bp, Artificial sequence
  SiRNA target sequence
attgtggaaaaattaggaaca

SEQ ID NO: 243556 - DNA, 21 bp, Artificial sequence
  SiRNA target sequence
ttgtggaaaaattaggaacaa

SEQ ID NO: 243557 - DNA, 21 bp, Artificial sequence
  SiRNA target sequence
tgtggaaaaattaggaacaat

SEQ ID NO: 243558 - DNA, 21 bp, Artificial sequence
  SiRNA target sequence
gtggaaaaattaggaacaatt

SEQ ID NO: 243559 - DNA, 21 bp, Artificial sequence
  SiRNA target sequence
tggaaaaattaggaacaattt

SEQ ID NO: 243560 - DNA, 21 bp, Artificial sequence
  SiRNA target sequence
ggaaaaattaggaacaatttc

SEQ ID NO: 243561 - DNA, 21 bp, Artificial sequence
  SiRNA target sequence
gaaaaattaggaacaatttct

SEQ ID NO: 243562 - DNA, 21 bp, Artificial sequence
  SiRNA target sequence
aaaaattaggaacaatttctt

SEQ ID NO: 243563 - DNA, 21 bp, Artificial sequence
  SiRNA target sequence
aaaattaggaacaatttcttt

SEQ ID NO: 243564 - DNA, 21 bp, Artificial sequence
  SiRNA target sequence
aaattaggaacaatttctttc

SEQ ID NO: 243565 - DNA, 21 bp, Artificial sequence
  SiRNA target sequence
aattaggaacaatttctttca

SEQ ID NO: 243566 - DNA, 21 bp, Artificial sequence
  SiRNA target sequence
attaggaacaatttctttcat

SEQ ID NO: 243567 - DNA, 21 bp, Artificial sequence
  SiRNA target sequence
ttaggaacaatttctttcatt

SEQ ID NO: 243568 - DNA, 21 bp, Artificial sequence
  SiRNA target sequence
taggaacaatttctttcattt

SEQ ID NO: 243569 - DNA, 21 bp, Artificial sequence
  SiRNA target sequence
aggaacaatttctttcatttc

SEQ ID NO: 243570 - DNA, 21 bp, Artificial sequence
  SiRNA target sequence
ggaacaatttctttcatttca

SEQ ID NO: 243571 - DNA, 21 bp, Artificial sequence
  SiRNA target sequence
gaacaatttctttcatttcat

SEQ ID NO: 243572 - DNA, 21 bp, Artificial sequence
  SiRNA target sequence
aacaatttctttcatttcatc

SEQ ID NO: 243573 - DNA, 21 bp, Artificial sequence
  SiRNA target sequence
acaatttctttcatttcatct

SEQ ID NO: 243574 - DNA, 21 bp, Artificial sequence
  SiRNA target sequence
caatttctttcatttcatctt

SEQ ID NO: 243575 - DNA, 21 bp, Artificial sequence
  SiRNA target sequence
aatttctttcatttcatcttc

SEQ ID NO: 243576 - DNA, 21 bp, Artificial sequence
  SiRNA target sequence
atttctttcatttcatcttct

SEQ ID NO: 243577 - DNA, 21 bp, Artificial sequence
  SiRNA target sequence
tttctttcatttcatcttctg

SEQ ID NO: 243578 - DNA, 21 bp, Artificial sequence
  SiRNA target sequence
ttctttcatttcatcttctgt

SEQ ID NO: 243579 - DNA, 21 bp, Artificial sequence
  SiRNA target sequence
tctttcatttcatcttctgta

SEQ ID NO: 243580 - DNA, 21 bp, Artificial sequence
  SiRNA target sequence
ctttcatttcatcttctgtac

SEQ ID NO: 243581 - DNA, 21 bp, Artificial sequence
  SiRNA target sequence
tttcatttcatcttctgtaca

SEQ ID NO: 243582 - DNA, 21 bp, Artificial sequence
  SiRNA target sequence
ttcatttcatcttctgtacaa

SEQ ID NO: 243583 - DNA, 21 bp, Artificial sequence
  SiRNA target sequence
tcatttcatcttctgtacaag

SEQ ID NO: 243584 - DNA, 21 bp, Artificial sequence
  SiRNA target sequence
catttcatcttctgtacaagc

SEQ ID NO: 243585 - DNA, 21 bp, Artificial sequence
  SiRNA target sequence
atttcatcttctgtacaagca

SEQ ID NO: 243586 - DNA, 21 bp, Artificial sequence
  SiRNA target sequence
tttcatcttctgtacaagcat

SEQ ID NO: 243587 - DNA, 21 bp, Artificial sequence
  SiRNA target sequence
ttcatcttctgtacaagcatg

SEQ ID NO: 243588 - DNA, 21 bp, Artificial sequence
  SiRNA target sequence
tcatcttctgtacaagcatga

SEQ ID NO: 243589 - DNA, 21 bp, Artificial sequence
  SiRNA target sequence
catcttctgtacaagcatgat

SEQ ID NO: 243590 - DNA, 21 bp, Artificial sequence
  SiRNA target sequence
atcttctgtacaagcatgatt

SEQ ID NO: 243591 - DNA, 21 bp, Artificial sequence
  SiRNA target sequence
tcttctgtacaagcatgattg

SEQ ID NO: 243592 - DNA, 21 bp, Artificial sequence
  SiRNA target sequence
cttctgtacaagcatgattgg

SEQ ID NO: 243593 - DNA, 21 bp, Artificial sequence
  SiRNA target sequence
ttctgtacaagcatgattggc

SEQ ID NO: 243594 - DNA, 21 bp, Artificial sequence
  SiRNA target sequence
tctgtacaagcatgattggct

SEQ ID NO: 243595 - DNA, 21 bp, Artificial sequence
  SiRNA target sequence
ctgtacaagcatgattggcta

SEQ ID NO: 243596 - DNA, 21 bp, Artificial sequence
  SiRNA target sequence
tgtacaagcatgattggctaa

SEQ ID NO: 243597 - DNA, 21 bp, Artificial sequence
  SiRNA target sequence
gtacaagcatgattggctaac

SEQ ID NO: 243598 - DNA, 21 bp, Artificial sequence
  SiRNA target sequence
tacaagcatgattggctaacg

SEQ ID NO: 243599 - DNA, 21 bp, Artificial sequence
  SiRNA target sequence
acaagcatgattggctaacgc

SEQ ID NO: 243600 - DNA, 21 bp, Artificial sequence
  SiRNA target sequence
caagcatgattggctaacgca

SEQ ID NO: 243601 - DNA, 21 bp, Artificial sequence
  SiRNA target sequence
aagcatgattggctaacgcat

SEQ ID NO: 243602 - DNA, 21 bp, Artificial sequence
  SiRNA target sequence
agcatgattggctaacgcata

SEQ ID NO: 243603 - DNA, 21 bp, Artificial sequence
  SiRNA target sequence
gcatgattggctaacgcatat

SEQ ID NO: 243604 - DNA, 21 bp, Artificial sequence
  SiRNA target sequence
catgattggctaacgcatata

SEQ ID NO: 243605 - DNA, 21 bp, Artificial sequence
  SiRNA target sequence
atgattggctaacgcatataa

SEQ ID NO: 243606 - DNA, 21 bp, Artificial sequence
  SiRNA target sequence
tgattggctaacgcatataaa

SEQ ID NO: 243607 - DNA, 21 bp, Artificial sequence
  SiRNA target sequence
gattggctaacgcatataaag

SEQ ID NO: 243608 - DNA, 21 bp, Artificial sequence
  SiRNA target sequence
attggctaacgcatataaagc

SEQ ID NO: 243609 - DNA, 21 bp, Artificial sequence
  SiRNA target sequence
ttggctaacgcatataaagca

SEQ ID NO: 243610 - DNA, 21 bp, Artificial sequence
  SiRNA target sequence
tggctaacgcatataaagcaa

SEQ ID NO: 243611 - DNA, 21 bp, Artificial sequence
  SiRNA target sequence
ggctaacgcatataaagcaaa

SEQ ID NO: 243612 - DNA, 21 bp, Artificial sequence
  SiRNA target sequence
gctaacgcatataaagcaaaa

SEQ ID NO: 243613 - DNA, 21 bp, Artificial sequence
  SiRNA target sequence
ctaacgcatataaagcaaaac

SEQ ID NO: 243614 - DNA, 21 bp, Artificial sequence
  SiRNA target sequence
taacgcatataaagcaaaacc

SEQ ID NO: 243615 - DNA, 21 bp, Artificial sequence
  SiRNA target sequence
aacgcatataaagcaaaacca

SEQ ID NO: 243616 - DNA, 21 bp, Artificial sequence
  SiRNA target sequence
acgcatataaagcaaaaccaa

SEQ ID NO: 243617 - DNA, 21 bp, Artificial sequence
  SiRNA target sequence
cgcatataaagcaaaaccaac

SEQ ID NO: 243618 - DNA, 21 bp, Artificial sequence
  SiRNA target sequence
gcatataaagcaaaaccaact

SEQ ID NO: 243619 - DNA, 21 bp, Artificial sequence
  SiRNA target sequence
catataaagcaaaaccaacta

SEQ ID NO: 243620 - DNA, 21 bp, Artificial sequence
  SiRNA target sequence
atataaagcaaaaccaactac

SEQ ID NO: 243621 - DNA, 21 bp, Artificial sequence
  SiRNA target sequence
tataaagcaaaaccaactact

SEQ ID NO: 243622 - DNA, 21 bp, Artificial sequence
  SiRNA target sequence
ataaagcaaaaccaactacta

SEQ ID NO: 243623 - DNA, 21 bp, Artificial sequence
  SiRNA target sequence
taaagcaaaaccaactactag

SEQ ID NO: 243624 - DNA, 21 bp, Artificial sequence
  SiRNA target sequence
aaagcaaaaccaactactaga

SEQ ID NO: 243625 - DNA, 21 bp, Artificial sequence
  SiRNA target sequence
aagcaaaaccaactactagag

SEQ ID NO: 243626 - DNA, 21 bp, Artificial sequence
  SiRNA target sequence
agcaaaaccaactactagagt

SEQ ID NO: 243627 - DNA, 21 bp, Artificial sequence
  SiRNA target sequence
gcaaaaccaactactagagta

SEQ ID NO: 243628 - DNA, 21 bp, Artificial sequence
  SiRNA target sequence
caaaaccaactactagagtac

SEQ ID NO: 243629 - DNA, 21 bp, Artificial sequence
  SiRNA target sequence
aaaaccaactactagagtact

SEQ ID NO: 243630 - DNA, 21 bp, Artificial sequence
  SiRNA target sequence
aaaccaactactagagtactc

SEQ ID NO: 243631 - DNA, 21 bp, Artificial sequence
  SiRNA target sequence
aaccaactactagagtactcc

SEQ ID NO: 243632 - DNA, 21 bp, Artificial sequence
  SiRNA target sequence
accaactactagagtactcca

SEQ ID NO: 243633 - DNA, 21 bp, Artificial sequence
  SiRNA target sequence
ccaactactagagtactccac

SEQ ID NO: 243634 - DNA, 21 bp, Artificial sequence
  SiRNA target sequence
caactactagagtactccaca

SEQ ID NO: 243635 - DNA, 21 bp, Artificial sequence
  SiRNA target sequence
aactactagagtactccacaa

SEQ ID NO: 243636 - DNA, 21 bp, Artificial sequence
  SiRNA target sequence
actactagagtactccacaac

SEQ ID NO: 243637 - DNA, 21 bp, Artificial sequence
  SiRNA target sequence
ctactagagtactccacaact

SEQ ID NO: 243638 - DNA, 21 bp, Artificial sequence
  SiRNA target sequence
tactagagtactccacaactc

SEQ ID NO: 243639 - DNA, 21 bp, Artificial sequence
  SiRNA target sequence
actagagtactccacaactcc

SEQ ID NO: 243640 - DNA, 21 bp, Artificial sequence
  SiRNA target sequence
ctagagtactccacaactccg

SEQ ID NO: 243641 - DNA, 21 bp, Artificial sequence
  SiRNA target sequence
tagagtactccacaactccga

SEQ ID NO: 243642 - DNA, 21 bp, Artificial sequence
  SiRNA target sequence
agagtactccacaactccgat

SEQ ID NO: 243643 - DNA, 21 bp, Artificial sequence
  SiRNA target sequence
gagtactccacaactccgata

SEQ ID NO: 243644 - DNA, 21 bp, Artificial sequence
  SiRNA target sequence
agtactccacaactccgataa

SEQ ID NO: 243645 - DNA, 21 bp, Artificial sequence
  SiRNA target sequence
gtactccacaactccgataag

SEQ ID NO: 243646 - DNA, 21 bp, Artificial sequence
  SiRNA target sequence
tactccacaactccgataaga

SEQ ID NO: 243647 - DNA, 21 bp, Artificial sequence
  SiRNA target sequence
actccacaactccgataagat

SEQ ID NO: 243648 - DNA, 21 bp, Artificial sequence
  SiRNA target sequence
ctccacaactccgataagatg

SEQ ID NO: 243649 - DNA, 21 bp, Artificial sequence
  SiRNA target sequence
tccacaactccgataagatgt

SEQ ID NO: 243650 - DNA, 21 bp, Artificial sequence
  SiRNA target sequence
ccacaactccgataagatgta

SEQ ID NO: 243651 - DNA, 21 bp, Artificial sequence
  SiRNA target sequence
cacaactccgataagatgtaa

SEQ ID NO: 243652 - DNA, 21 bp, Artificial sequence
  SiRNA target sequence
acaactccgataagatgtaac

SEQ ID NO: 243653 - DNA, 21 bp, Artificial sequence
  SiRNA target sequence
caactccgataagatgtaaca

SEQ ID NO: 243654 - DNA, 21 bp, Artificial sequence
  SiRNA target sequence
aactccgataagatgtaacat

SEQ ID NO: 243655 - DNA, 21 bp, Artificial sequence
  SiRNA target sequence
actccgataagatgtaacata

SEQ ID NO: 243656 - DNA, 21 bp, Artificial sequence
  SiRNA target sequence
ctccgataagatgtaacataa

SEQ ID NO: 243657 - DNA, 21 bp, Artificial sequence
  SiRNA target sequence
tccgataagatgtaacataaa

SEQ ID NO: 243658 - DNA, 21 bp, Artificial sequence
  SiRNA target sequence
ccgataagatgtaacataaag

SEQ ID NO: 243659 - DNA, 21 bp, Artificial sequence
  SiRNA target sequence
cgataagatgtaacataaagt

SEQ ID NO: 243660 - DNA, 21 bp, Artificial sequence
  SiRNA target sequence
gataagatgtaacataaagta

SEQ ID NO: 243661 - DNA, 21 bp, Artificial sequence
  SiRNA target sequence
ataagatgtaacataaagtac

SEQ ID NO: 243662 - DNA, 21 bp, Artificial sequence
  SiRNA target sequence
taagatgtaacataaagtact

SEQ ID NO: 243663 - DNA, 21 bp, Artificial sequence
  SiRNA target sequence
aagatgtaacataaagtactt

SEQ ID NO: 243664 - DNA, 21 bp, Artificial sequence
  SiRNA target sequence
agatgtaacataaagtactta

SEQ ID NO: 243665 - DNA, 21 bp, Artificial sequence
  SiRNA target sequence
gatgtaacataaagtacttat

SEQ ID NO: 243666 - DNA, 21 bp, Artificial sequence
  SiRNA target sequence
atgtaacataaagtacttatc

SEQ ID NO: 243667 - DNA, 21 bp, Artificial sequence
  SiRNA target sequence
tgtaacataaagtacttatcc

SEQ ID NO: 243668 - DNA, 21 bp, Artificial sequence
  SiRNA target sequence
gtaacataaagtacttatcca

SEQ ID NO: 243669 - DNA, 21 bp, Artificial sequence
  SiRNA target sequence
taacataaagtacttatccac

SEQ ID NO: 243670 - DNA, 21 bp, Artificial sequence
  SiRNA target sequence
aacataaagtacttatccact

SEQ ID NO: 243671 - DNA, 21 bp, Artificial sequence
  SiRNA target sequence
acataaagtacttatccactc

SEQ ID NO: 243672 - DNA, 21 bp, Artificial sequence
  SiRNA target sequence
cataaagtacttatccactca

SEQ ID NO: 243673 - DNA, 21 bp, Artificial sequence
  SiRNA target sequence
ataaagtacttatccactcac

SEQ ID NO: 243674 - DNA, 21 bp, Artificial sequence
  SiRNA target sequence
taaagtacttatccactcact

SEQ ID NO: 243675 - DNA, 21 bp, Artificial sequence
  SiRNA target sequence
aaagtacttatccactcactg

SEQ ID NO: 243676 - DNA, 21 bp, Artificial sequence
  SiRNA target sequence
aagtacttatccactcactgt

SEQ ID NO: 243677 - DNA, 21 bp, Artificial sequence
  SiRNA target sequence
agtacttatccactcactgta

SEQ ID NO: 243678 - DNA, 21 bp, Artificial sequence
  SiRNA target sequence
gtacttatccactcactgtac

SEQ ID NO: 243679 - DNA, 21 bp, Artificial sequence
  SiRNA target sequence
tacttatccactcactgtaca

SEQ ID NO: 243680 - DNA, 21 bp, Artificial sequence
  SiRNA target sequence
acttatccactcactgtacat

SEQ ID NO: 243681 - DNA, 21 bp, Artificial sequence
  SiRNA target sequence
cttatccactcactgtacata

SEQ ID NO: 243682 - DNA, 21 bp, Artificial sequence
  SiRNA target sequence
ttatccactcactgtacatat

SEQ ID NO: 243683 - DNA, 21 bp, Artificial sequence
  SiRNA target sequence
tatccactcactgtacatata

SEQ ID NO: 243684 - DNA, 21 bp, Artificial sequence
  SiRNA target sequence
atccactcactgtacatatat

SEQ ID NO: 243685 - DNA, 21 bp, Artificial sequence
  SiRNA target sequence
tccactcactgtacatatata

SEQ ID NO: 243686 - DNA, 21 bp, Artificial sequence
  SiRNA target sequence
ccactcactgtacatatataa

SEQ ID NO: 243687 - DNA, 21 bp, Artificial sequence
  SiRNA target sequence
cactcactgtacatatataaa

SEQ ID NO: 243688 - DNA, 21 bp, Artificial sequence
  SiRNA target sequence
actcactgtacatatataaaa

SEQ ID NO: 243689 - DNA, 21 bp, Artificial sequence
  SiRNA target sequence
ctcactgtacatatataaaaa

SEQ ID NO: 243690 - DNA, 21 bp, Artificial sequence
  SiRNA target sequence
tcactgtacatatataaaaaa

SEQ ID NO: 243691 - DNA, 21 bp, Artificial sequence
  SiRNA target sequence
cactgtacatatataaaaaag

SEQ ID NO: 243692 - DNA, 21 bp, Artificial sequence
  SiRNA target sequence
actgtacatatataaaaaagg

SEQ ID NO: 243693 - DNA, 21 bp, Artificial sequence
  SiRNA target sequence
ctgtacatatataaaaaagga

SEQ ID NO: 243694 - DNA, 21 bp, Artificial sequence
  SiRNA target sequence
tgtacatatataaaaaaggag

SEQ ID NO: 243695 - DNA, 21 bp, Artificial sequence
  SiRNA target sequence
gtacatatataaaaaaggaga

SEQ ID NO: 243696 - DNA, 21 bp, Artificial sequence
  SiRNA target sequence
tacatatataaaaaaggagat

SEQ ID NO: 243697 - DNA, 21 bp, Artificial sequence
  SiRNA target sequence
acatatataaaaaaggagata

SEQ ID NO: 243698 - DNA, 21 bp, Artificial sequence
  SiRNA target sequence
catatataaaaaaggagataa

SEQ ID NO: 243699 - DNA, 21 bp, Artificial sequence
  SiRNA target sequence
atatataaaaaaggagataag

SEQ ID NO: 243700 - DNA, 21 bp, Artificial sequence
  SiRNA target sequence
tatataaaaaaggagataagc

SEQ ID NO: 243701 - DNA, 21 bp, Artificial sequence
  SiRNA target sequence
atataaaaaaggagataagcc

SEQ ID NO: 243702 - DNA, 21 bp, Artificial sequence
  SiRNA target sequence
tataaaaaaggagataagccc

SEQ ID NO: 243703 - DNA, 21 bp, Artificial sequence
  SiRNA target sequence
ataaaaaaggagataagccca

SEQ ID NO: 243704 - DNA, 21 bp, Artificial sequence
  SiRNA target sequence
taaaaaaggagataagcccat

SEQ ID NO: 243705 - DNA, 21 bp, Artificial sequence
  SiRNA target sequence
aaaaaaggagataagcccatc

SEQ ID NO: 243706 - DNA, 21 bp, Artificial sequence
  SiRNA target sequence
aaaaaggagataagcccatca

SEQ ID NO: 243707 - DNA, 21 bp, Artificial sequence
  SiRNA target sequence
aaaaggagataagcccatcaa

SEQ ID NO: 243708 - DNA, 21 bp, Artificial sequence
  SiRNA target sequence
aaaggagataagcccatcaag

SEQ ID NO: 243709 - DNA, 21 bp, Artificial sequence
  SiRNA target sequence
aaggagataagcccatcaagc

SEQ ID NO: 243710 - DNA, 21 bp, Artificial sequence
  SiRNA target sequence
aggagataagcccatcaagct

SEQ ID NO: 243711 - DNA, 21 bp, Artificial sequence
  SiRNA target sequence
ggagataagcccatcaagctt

SEQ ID NO: 243712 - DNA, 21 bp, Artificial sequence
  SiRNA target sequence
gagataagcccatcaagcttc

SEQ ID NO: 243713 - DNA, 21 bp, Artificial sequence
  SiRNA target sequence
agataagcccatcaagcttct

SEQ ID NO: 243714 - DNA, 21 bp, Artificial sequence
  SiRNA target sequence
gataagcccatcaagcttcta

SEQ ID NO: 243715 - DNA, 21 bp, Artificial sequence
  SiRNA target sequence
ataagcccatcaagcttctaa

SEQ ID NO: 243716 - DNA, 21 bp, Artificial sequence
  SiRNA target sequence
taagcccatcaagcttctaac

SEQ ID NO: 243717 - DNA, 21 bp, Artificial sequence
  SiRNA target sequence
aagcccatcaagcttctaact

SEQ ID NO: 243718 - DNA, 21 bp, Artificial sequence
  SiRNA target sequence
agcccatcaagcttctaactg

SEQ ID NO: 243719 - DNA, 21 bp, Artificial sequence
  SiRNA target sequence
gcccatcaagcttctaactga

SEQ ID NO: 243720 - DNA, 21 bp, Artificial sequence
  SiRNA target sequence
cccatcaagcttctaactgac

SEQ ID NO: 243721 - DNA, 21 bp, Artificial sequence
  SiRNA target sequence
ccatcaagcttctaactgaca

SEQ ID NO: 243722 - DNA, 21 bp, Artificial sequence
  SiRNA target sequence
catcaagcttctaactgacat

SEQ ID NO: 243723 - DNA, 21 bp, Artificial sequence
  SiRNA target sequence
atcaagcttctaactgacatc

SEQ ID NO: 243724 - DNA, 21 bp, Artificial sequence
  SiRNA target sequence
tcaagcttctaactgacatct

SEQ ID NO: 243725 - DNA, 21 bp, Artificial sequence
  SiRNA target sequence
caagcttctaactgacatctt

SEQ ID NO: 243726 - DNA, 21 bp, Artificial sequence
  SiRNA target sequence
aagcttctaactgacatctta

SEQ ID NO: 243727 - DNA, 21 bp, Artificial sequence
  SiRNA target sequence
agcttctaactgacatcttac

SEQ ID NO: 243728 - DNA, 21 bp, Artificial sequence
  SiRNA target sequence
gcttctaactgacatcttacc

SEQ ID NO: 243729 - DNA, 21 bp, Artificial sequence
  SiRNA target sequence
cttctaactgacatcttacca

SEQ ID NO: 243730 - DNA, 21 bp, Artificial sequence
  SiRNA target sequence
ttctaactgacatcttaccat

SEQ ID NO: 243731 - DNA, 21 bp, Artificial sequence
  SiRNA target sequence
tctaactgacatcttaccatc

SEQ ID NO: 243732 - DNA, 21 bp, Artificial sequence
  SiRNA target sequence
ctaactgacatcttaccatca

SEQ ID NO: 243733 - DNA, 21 bp, Artificial sequence
  SiRNA target sequence
taactgacatcttaccatcac

SEQ ID NO: 243734 - DNA, 21 bp, Artificial sequence
  SiRNA target sequence
aactgacatcttaccatcaca

SEQ ID NO: 243735 - DNA, 21 bp, Artificial sequence
  SiRNA target sequence
actgacatcttaccatcacaa

SEQ ID NO: 243736 - DNA, 21 bp, Artificial sequence
  SiRNA target sequence
ctgacatcttaccatcacaaa

SEQ ID NO: 243737 - DNA, 21 bp, Artificial sequence
  SiRNA target sequence
tgacatcttaccatcacaaaa

SEQ ID NO: 243738 - DNA, 21 bp, Artificial sequence
  SiRNA target sequence
gacatcttaccatcacaaaaa

SEQ ID NO: 243739 - DNA, 21 bp, Artificial sequence
  SiRNA target sequence
acatcttaccatcacaaaaaa

SEQ ID NO: 243740 - DNA, 21 bp, Artificial sequence
  SiRNA target sequence
catcttaccatcacaaaaaat

SEQ ID NO: 243741 - DNA, 21 bp, Artificial sequence
  SiRNA target sequence
atcttaccatcacaaaaaata

SEQ ID NO: 243742 - DNA, 21 bp, Artificial sequence
  SiRNA target sequence
tcttaccatcacaaaaaatat

SEQ ID NO: 243743 - DNA, 21 bp, Artificial sequence
  SiRNA target sequence
cttaccatcacaaaaaatatc

SEQ ID NO: 243744 - DNA, 21 bp, Artificial sequence
  SiRNA target sequence
ttaccatcacaaaaaatatct

SEQ ID NO: 243745 - DNA, 21 bp, Artificial sequence
  SiRNA target sequence
taccatcacaaaaaatatcta

SEQ ID NO: 243746 - DNA, 21 bp, Artificial sequence
  SiRNA target sequence
accatcacaaaaaatatctag

SEQ ID NO: 243747 - DNA, 21 bp, Artificial sequence
  SiRNA target sequence
ccatcacaaaaaatatctagt

SEQ ID NO: 243748 - DNA, 21 bp, Artificial sequence
  SiRNA target sequence
catcacaaaaaatatctagtg

SEQ ID NO: 243749 - DNA, 21 bp, Artificial sequence
  SiRNA target sequence
atcacaaaaaatatctagtgc

SEQ ID NO: 243750 - DNA, 21 bp, Artificial sequence
  SiRNA target sequence
tcacaaaaaatatctagtgcc

SEQ ID NO: 243751 - DNA, 21 bp, Artificial sequence
  SiRNA target sequence
cacaaaaaatatctagtgccc

SEQ ID NO: 243752 - DNA, 21 bp, Artificial sequence
  SiRNA target sequence
acaaaaaatatctagtgccca

SEQ ID NO: 243753 - DNA, 21 bp, Artificial sequence
  SiRNA target sequence
caaaaaatatctagtgcccat

SEQ ID NO: 243754 - DNA, 21 bp, Artificial sequence
  SiRNA target sequence
aaaaaatatctagtgcccatt

SEQ ID NO: 243755 - DNA, 21 bp, Artificial sequence
  SiRNA target sequence
aaaaatatctagtgcccattg

SEQ ID NO: 243756 - DNA, 21 bp, Artificial sequence
  SiRNA target sequence
aaaatatctagtgcccattgt

SEQ ID NO: 243757 - DNA, 21 bp, Artificial sequence
  SiRNA target sequence
aaatatctagtgcccattgtg

SEQ ID NO: 243758 - DNA, 21 bp, Artificial sequence
  SiRNA target sequence
aatatctagtgcccattgtga

SEQ ID NO: 243759 - DNA, 21 bp, Artificial sequence
  SiRNA target sequence
atatctagtgcccattgtgat

SEQ ID NO: 243760 - DNA, 21 bp, Artificial sequence
  SiRNA target sequence
tatctagtgcccattgtgatc

SEQ ID NO: 243761 - DNA, 21 bp, Artificial sequence
  SiRNA target sequence
atctagtgcccattgtgatcc

SEQ ID NO: 243762 - DNA, 21 bp, Artificial sequence
  SiRNA target sequence
tctagtgcccattgtgatcct

SEQ ID NO: 243763 - DNA, 21 bp, Artificial sequence
  SiRNA target sequence
ctagtgcccattgtgatcctt

SEQ ID NO: 243764 - DNA, 21 bp, Artificial sequence
  SiRNA target sequence
tagtgcccattgtgatccttt

SEQ ID NO: 243765 - DNA, 21 bp, Artificial sequence
  SiRNA target sequence
agtgcccattgtgatcctttt

SEQ ID NO: 243766 - DNA, 21 bp, Artificial sequence
  SiRNA target sequence
gtgcccattgtgatccttttt

SEQ ID NO: 243767 - DNA, 21 bp, Artificial sequence
  SiRNA target sequence
tgcccattgtgatcctttttg

SEQ ID NO: 243768 - DNA, 21 bp, Artificial sequence
  SiRNA target sequence
gcccattgtgatcctttttgg

SEQ ID NO: 243769 - DNA, 21 bp, Artificial sequence
  SiRNA target sequence
cccattgtgatcctttttgga

SEQ ID NO: 243770 - DNA, 21 bp, Artificial sequence
  SiRNA target sequence
ccattgtgatcctttttggat

SEQ ID NO: 243771 - DNA, 21 bp, Artificial sequence
  SiRNA target sequence
cattgtgatcctttttggatt

SEQ ID NO: 243772 - DNA, 21 bp, Artificial sequence
  SiRNA target sequence
attgtgatcctttttggattt

SEQ ID NO: 243773 - DNA, 21 bp, Artificial sequence
  SiRNA target sequence
ttgtgatcctttttggatttt

SEQ ID NO: 243774 - DNA, 21 bp, Artificial sequence
  SiRNA target sequence
tgtgatcctttttggatttta

SEQ ID NO: 243775 - DNA, 21 bp, Artificial sequence
  SiRNA target sequence
gtgatcctttttggattttat

SEQ ID NO: 243776 - DNA, 21 bp, Artificial sequence
  SiRNA target sequence
tgatcctttttggattttata

SEQ ID NO: 243777 - DNA, 21 bp, Artificial sequence
  SiRNA target sequence
gatcctttttggattttatat

SEQ ID NO: 243778 - DNA, 21 bp, Artificial sequence
  SiRNA target sequence
atcctttttggattttatatt

SEQ ID NO: 243779 - DNA, 21 bp, Artificial sequence
  SiRNA target sequence
tcctttttggattttatattc

SEQ ID NO: 243780 - DNA, 21 bp, Artificial sequence
  SiRNA target sequence
cctttttggattttatattca

SEQ ID NO: 243781 - DNA, 21 bp, Artificial sequence
  SiRNA target sequence
ctttttggattttatattcaa

SEQ ID NO: 243782 - DNA, 21 bp, Artificial sequence
  SiRNA target sequence
tttttggattttatattcaaa

SEQ ID NO: 243783 - DNA, 21 bp, Artificial sequence
  SiRNA target sequence
ttttggattttatattcaaat

SEQ ID NO: 243784 - DNA, 21 bp, Artificial sequence
  SiRNA target sequence
tttggattttatattcaaatg

SEQ ID NO: 243785 - DNA, 21 bp, Artificial sequence
  SiRNA target sequence
ttggattttatattcaaatgg

SEQ ID NO: 243786 - DNA, 21 bp, Artificial sequence
  SiRNA target sequence
tggattttatattcaaatgga

SEQ ID NO: 243787 - DNA, 21 bp, Artificial sequence
  SiRNA target sequence
ggattttatattcaaatggaa

SEQ ID NO: 243788 - DNA, 21 bp, Artificial sequence
  SiRNA target sequence
gattttatattcaaatggaat

SEQ ID NO: 243789 - DNA, 21 bp, Artificial sequence
  SiRNA target sequence
attttatattcaaatggaatt

SEQ ID NO: 243790 - DNA, 21 bp, Artificial sequence
  SiRNA target sequence
ttttatattcaaatggaatta

SEQ ID NO: 243791 - DNA, 21 bp, Artificial sequence
  SiRNA target sequence
tttatattcaaatggaattaa

SEQ ID NO: 243792 - DNA, 21 bp, Artificial sequence
  SiRNA target sequence
ttatattcaaatggaattaaa

SEQ ID NO: 243793 - DNA, 21 bp, Artificial sequence
  SiRNA target sequence
tatattcaaatggaattaaaa

SEQ ID NO: 243794 - DNA, 21 bp, Artificial sequence
  SiRNA target sequence
atattcaaatggaattaaaag

SEQ ID NO: 243795 - DNA, 21 bp, Artificial sequence
  SiRNA target sequence
tattcaaatggaattaaaaga

SEQ ID NO: 243796 - DNA, 21 bp, Artificial sequence
  SiRNA target sequence
attcaaatggaattaaaagag

SEQ ID NO: 243797 - DNA, 21 bp, Artificial sequence
  SiRNA target sequence
ttcaaatggaattaaaagaga

SEQ ID NO: 243798 - DNA, 21 bp, Artificial sequence
  SiRNA target sequence
tcaaatggaattaaaagagaa

SEQ ID NO: 243799 - DNA, 21 bp, Artificial sequence
  SiRNA target sequence
caaatggaattaaaagagaac

SEQ ID NO: 243800 - DNA, 21 bp, Artificial sequence
  SiRNA target sequence
aaatggaattaaaagagaacc

SEQ ID NO: 243801 - DNA, 21 bp, Artificial sequence
  SiRNA target sequence
aatggaattaaaagagaacca

SEQ ID NO: 243802 - DNA, 21 bp, Artificial sequence
  SiRNA target sequence
atggaattaaaagagaaccaa

SEQ ID NO: 243803 - DNA, 21 bp, Artificial sequence
  SiRNA target sequence
tggaattaaaagagaaccaat

SEQ ID NO: 243804 - DNA, 21 bp, Artificial sequence
  SiRNA target sequence
ggaattaaaagagaaccaatt

SEQ ID NO: 243805 - DNA, 21 bp, Artificial sequence
  SiRNA target sequence
gaattaaaagagaaccaatta

SEQ ID NO: 243806 - DNA, 21 bp, Artificial sequence
  SiRNA target sequence
aattaaaagagaaccaattag

SEQ ID NO: 243807 - DNA, 21 bp, Artificial sequence
  SiRNA target sequence
attaaaagagaaccaattaga

SEQ ID NO: 243808 - DNA, 21 bp, Artificial sequence
  SiRNA target sequence
ttaaaagagaaccaattagaa

SEQ ID NO: 243809 - DNA, 21 bp, Artificial sequence
  SiRNA target sequence
taaaagagaaccaattagaaa

SEQ ID NO: 243810 - DNA, 21 bp, Artificial sequence
  SiRNA target sequence
aaaagagaaccaattagaaaa

SEQ ID NO: 243811 - DNA, 21 bp, Artificial sequence
  SiRNA target sequence
aaagagaaccaattagaaaaa

SEQ ID NO: 243812 - DNA, 21 bp, Artificial sequence
  SiRNA target sequence
aagagaaccaattagaaaaaa

SEQ ID NO: 243813 - DNA, 21 bp, Artificial sequence
  SiRNA target sequence
agagaaccaattagaaaaaaa

SEQ ID NO: 243814 - DNA, 21 bp, Artificial sequence
  SiRNA target sequence
gagaaccaattagaaaaaaaa

SEQ ID NO: 243815 - DNA, 21 bp, Artificial sequence
  SiRNA target sequence
agaaccaattagaaaaaaaat

SEQ ID NO: 243816 - DNA, 21 bp, Artificial sequence
  SiRNA target sequence
gaaccaattagaaaaaaaatg

SEQ ID NO: 243817 - DNA, 21 bp, Artificial sequence
  SiRNA target sequence
aaccaattagaaaaaaaatgc

SEQ ID NO: 243818 - DNA, 21 bp, Artificial sequence
  SiRNA target sequence
accaattagaaaaaaaatgcc

SEQ ID NO: 243819 - DNA, 21 bp, Artificial sequence
  SiRNA target sequence
ccaattagaaaaaaaatgcca

SEQ ID NO: 243820 - DNA, 21 bp, Artificial sequence
  SiRNA target sequence
caattagaaaaaaaatgccaa

SEQ ID NO: 243821 - DNA, 21 bp, Artificial sequence
  SiRNA target sequence
aattagaaaaaaaatgccaat

SEQ ID NO: 243822 - DNA, 21 bp, Artificial sequence
  SiRNA target sequence
attagaaaaaaaatgccaata

SEQ ID NO: 243823 - DNA, 21 bp, Artificial sequence
  SiRNA target sequence
ttagaaaaaaaatgccaataa

SEQ ID NO: 243824 - DNA, 21 bp, Artificial sequence
  SiRNA target sequence
tagaaaaaaaatgccaataaa

SEQ ID NO: 243825 - DNA, 21 bp, Artificial sequence
  SiRNA target sequence
agaaaaaaaatgccaataaaa

SEQ ID NO: 243826 - DNA, 21 bp, Artificial sequence
  SiRNA target sequence
gaaaaaaaatgccaataaaac

SEQ ID NO: 243827 - DNA, 21 bp, Artificial sequence
  SiRNA target sequence
aaaaaaaatgccaataaaacc

SEQ ID NO: 243828 - DNA, 21 bp, Artificial sequence
  SiRNA target sequence
aaaaaaatgccaataaaacca

SEQ ID NO: 243829 - DNA, 21 bp, Artificial sequence
  SiRNA target sequence
aaaaaatgccaataaaaccaa

SEQ ID NO: 243830 - DNA, 21 bp, Artificial sequence
  SiRNA target sequence
aaaaatgccaataaaaccaaa

SEQ ID NO: 243831 - DNA, 21 bp, Artificial sequence
  SiRNA target sequence
aaaatgccaataaaaccaaaa

SEQ ID NO: 243832 - DNA, 21 bp, Artificial sequence
  SiRNA target sequence
aaatgccaataaaaccaaaaa

SEQ ID NO: 243833 - DNA, 21 bp, Artificial sequence
  SiRNA target sequence
aatgccaataaaaccaaaaat

SEQ ID NO: 243834 - DNA, 21 bp, Artificial sequence
  SiRNA target sequence
atgccaataaaaccaaaaata

SEQ ID NO: 243835 - DNA, 21 bp, Artificial sequence
  SiRNA target sequence
tgccaataaaaccaaaaataa

SEQ ID NO: 243836 - DNA, 21 bp, Artificial sequence
  SiRNA target sequence
gccaataaaaccaaaaataat

SEQ ID NO: 243837 - DNA, 21 bp, Artificial sequence
  SiRNA target sequence
ccaataaaaccaaaaataata

SEQ ID NO: 243838 - DNA, 21 bp, Artificial sequence
  SiRNA target sequence
caataaaaccaaaaataataa

SEQ ID NO: 243839 - DNA, 21 bp, Artificial sequence
  SiRNA target sequence
aataaaaccaaaaataataaa

SEQ ID NO: 243840 - DNA, 21 bp, Artificial sequence
  SiRNA target sequence
ataaaaccaaaaataataaaa

SEQ ID NO: 243841 - DNA, 21 bp, Artificial sequence
  SiRNA target sequence
taaaaccaaaaataataaaat

SEQ ID NO: 243842 - DNA, 21 bp, Artificial sequence
  SiRNA target sequence
aaaaccaaaaataataaaatt

SEQ ID NO: 243843 - DNA, 21 bp, Artificial sequence
  SiRNA target sequence
aaaccaaaaataataaaattc

SEQ ID NO: 243844 - DNA, 21 bp, Artificial sequence
  SiRNA target sequence
aaccaaaaataataaaattca

SEQ ID NO: 243845 - DNA, 21 bp, Artificial sequence
  SiRNA target sequence
accaaaaataataaaattcac

SEQ ID NO: 243846 - DNA, 21 bp, Artificial sequence
  SiRNA target sequence
ccaaaaataataaaattcaca

SEQ ID NO: 243847 - DNA, 21 bp, Artificial sequence
  SiRNA target sequence
caaaaataataaaattcacaa

SEQ ID NO: 243848 - DNA, 21 bp, Artificial sequence
  SiRNA target sequence
aaaaataataaaattcacaat

SEQ ID NO: 243849 - DNA, 21 bp, Artificial sequence
  SiRNA target sequence
aaaataataaaattcacaata

SEQ ID NO: 243850 - DNA, 21 bp, Artificial sequence
  SiRNA target sequence
aaataataaaattcacaatac

SEQ ID NO: 243851 - DNA, 21 bp, Artificial sequence
  SiRNA target sequence
aataataaaattcacaatact

SEQ ID NO: 243852 - DNA, 21 bp, Artificial sequence
  SiRNA target sequence
ataataaaattcacaatacta

SEQ ID NO: 243853 - DNA, 21 bp, Artificial sequence
  SiRNA target sequence
taataaaattcacaatactaa

SEQ ID NO: 243854 - DNA, 21 bp, Artificial sequence
  SiRNA target sequence
aataaaattcacaatactaag

SEQ ID NO: 243855 - DNA, 21 bp, Artificial sequence
  SiRNA target sequence
ataaaattcacaatactaaga

SEQ ID NO: 243856 - DNA, 21 bp, Artificial sequence
  SiRNA target sequence
taaaattcacaatactaagaa

SEQ ID NO: 243857 - DNA, 21 bp, Artificial sequence
  SiRNA target sequence
aaaattcacaatactaagaat

SEQ ID NO: 243858 - DNA, 21 bp, Artificial sequence
  SiRNA target sequence
aaattcacaatactaagaata

SEQ ID NO: 243859 - DNA, 21 bp, Artificial sequence
  SiRNA target sequence
aattcacaatactaagaatag

SEQ ID NO: 243860 - DNA, 21 bp, Artificial sequence
  SiRNA target sequence
attcacaatactaagaataga

SEQ ID NO: 243861 - DNA, 21 bp, Artificial sequence
  SiRNA target sequence
ttcacaatactaagaatagag

SEQ ID NO: 243862 - DNA, 21 bp, Artificial sequence
  SiRNA target sequence
tcacaatactaagaatagagt

SEQ ID NO: 243863 - DNA, 21 bp, Artificial sequence
  SiRNA target sequence
cacaatactaagaatagagta

SEQ ID NO: 243864 - DNA, 21 bp, Artificial sequence
  SiRNA target sequence
acaatactaagaatagagtac

SEQ ID NO: 243865 - DNA, 21 bp, Artificial sequence
  SiRNA target sequence
caatactaagaatagagtaca

SEQ ID NO: 243866 - DNA, 21 bp, Artificial sequence
  SiRNA target sequence
aatactaagaatagagtacac

SEQ ID NO: 243867 - DNA, 21 bp, Artificial sequence
  SiRNA target sequence
atactaagaatagagtacaca

SEQ ID NO: 243868 - DNA, 21 bp, Artificial sequence
  SiRNA target sequence
tactaagaatagagtacacat

SEQ ID NO: 243869 - DNA, 21 bp, Artificial sequence
  SiRNA target sequence
actaagaatagagtacacatt

SEQ ID NO: 243870 - DNA, 21 bp, Artificial sequence
  SiRNA target sequence
ctaagaatagagtacacattt

SEQ ID NO: 243871 - DNA, 21 bp, Artificial sequence
  SiRNA target sequence
taagaatagagtacacattta

SEQ ID NO: 243872 - DNA, 21 bp, Artificial sequence
  SiRNA target sequence
aagaatagagtacacatttaa

SEQ ID NO: 243873 - DNA, 21 bp, Artificial sequence
  SiRNA target sequence
agaatagagtacacatttaaa

SEQ ID NO: 243874 - DNA, 21 bp, Artificial sequence
  SiRNA target sequence
gaatagagtacacatttaaag

SEQ ID NO: 243875 - DNA, 21 bp, Artificial sequence
  SiRNA target sequence
aatagagtacacatttaaagc

SEQ ID NO: 243876 - DNA, 21 bp, Artificial sequence
  SiRNA target sequence
atagagtacacatttaaagcc

SEQ ID NO: 243877 - DNA, 21 bp, Artificial sequence
  SiRNA target sequence
tagagtacacatttaaagcct

SEQ ID NO: 243878 - DNA, 21 bp, Artificial sequence
  SiRNA target sequence
agagtacacatttaaagcctt

SEQ ID NO: 243879 - DNA, 21 bp, Artificial sequence
  SiRNA target sequence
gagtacacatttaaagccttt

SEQ ID NO: 243880 - DNA, 21 bp, Artificial sequence
  SiRNA target sequence
agtacacatttaaagcctttt

SEQ ID NO: 243881 - DNA, 21 bp, Artificial sequence
  SiRNA target sequence
gtacacatttaaagccttttg

SEQ ID NO: 243882 - DNA, 21 bp, Artificial sequence
  SiRNA target sequence
tacacatttaaagccttttgg

SEQ ID NO: 243883 - DNA, 21 bp, Artificial sequence
  SiRNA target sequence
acacatttaaagccttttgga

SEQ ID NO: 243884 - DNA, 21 bp, Artificial sequence
  SiRNA target sequence
cacatttaaagccttttggac

SEQ ID NO: 243885 - DNA, 21 bp, Artificial sequence
  SiRNA target sequence
acatttaaagccttttggaca

SEQ ID NO: 243886 - DNA, 21 bp, Artificial sequence
  SiRNA target sequence
catttaaagccttttggacat

SEQ ID NO: 243887 - DNA, 21 bp, Artificial sequence
  SiRNA target sequence
atttaaagccttttggacata

SEQ ID NO: 243888 - DNA, 21 bp, Artificial sequence
  SiRNA target sequence
tttaaagccttttggacatat

SEQ ID NO: 243889 - DNA, 21 bp, Artificial sequence
  SiRNA target sequence
ttaaagccttttggacatatg

SEQ ID NO: 243890 - DNA, 21 bp, Artificial sequence
  SiRNA target sequence
taaagccttttggacatatga

SEQ ID NO: 243891 - DNA, 21 bp, Artificial sequence
  SiRNA target sequence
aaagccttttggacatatgac

SEQ ID NO: 243892 - DNA, 21 bp, Artificial sequence
  SiRNA target sequence
aagccttttggacatatgaca

SEQ ID NO: 243893 - DNA, 21 bp, Artificial sequence
  SiRNA target sequence
agccttttggacatatgacat

SEQ ID NO: 243894 - DNA, 21 bp, Artificial sequence
  SiRNA target sequence
gccttttggacatatgacatc

SEQ ID NO: 243895 - DNA, 21 bp, Artificial sequence
  SiRNA target sequence
ccttttggacatatgacatca

SEQ ID NO: 243896 - DNA, 21 bp, Artificial sequence
  SiRNA target sequence
cttttggacatatgacatcat

SEQ ID NO: 243897 - DNA, 21 bp, Artificial sequence
  SiRNA target sequence
ttttggacatatgacatcata

SEQ ID NO: 243898 - DNA, 21 bp, Artificial sequence
  SiRNA target sequence
tttggacatatgacatcataa

SEQ ID NO: 243899 - DNA, 21 bp, Artificial sequence
  SiRNA target sequence
ttggacatatgacatcataag

SEQ ID NO: 243900 - DNA, 21 bp, Artificial sequence
  SiRNA target sequence
tggacatatgacatcataaga

SEQ ID NO: 243901 - DNA, 21 bp, Artificial sequence
  SiRNA target sequence
ggacatatgacatcataagac

SEQ ID NO: 243902 - DNA, 21 bp, Artificial sequence
  SiRNA target sequence
gacatatgacatcataagaca

SEQ ID NO: 243903 - DNA, 21 bp, Artificial sequence
  SiRNA target sequence
acatatgacatcataagacat

SEQ ID NO: 243904 - DNA, 21 bp, Artificial sequence
  SiRNA target sequence
catatgacatcataagacata

SEQ ID NO: 243905 - DNA, 21 bp, Artificial sequence
  SiRNA target sequence
atatgacatcataagacatat

SEQ ID NO: 243906 - DNA, 21 bp, Artificial sequence
  SiRNA target sequence
tatgacatcataagacatata

SEQ ID NO: 243907 - DNA, 21 bp, Artificial sequence
  SiRNA target sequence
atgacatcataagacatataa

SEQ ID NO: 243908 - DNA, 21 bp, Artificial sequence
  SiRNA target sequence
tgacatcataagacatataat

SEQ ID NO: 243909 - DNA, 21 bp, Artificial sequence
  SiRNA target sequence
gacatcataagacatataatt

SEQ ID NO: 243910 - DNA, 21 bp, Artificial sequence
  SiRNA target sequence
acatcataagacatataattg

SEQ ID NO: 243911 - DNA, 21 bp, Artificial sequence
  SiRNA target sequence
catcataagacatataattgg

SEQ ID NO: 243912 - DNA, 21 bp, Artificial sequence
  SiRNA target sequence
atcataagacatataattggc

SEQ ID NO: 243913 - DNA, 21 bp, Artificial sequence
  SiRNA target sequence
tcataagacatataattggca

SEQ ID NO: 243914 - DNA, 21 bp, Artificial sequence
  SiRNA target sequence
cataagacatataattggcag

SEQ ID NO: 243915 - DNA, 21 bp, Artificial sequence
  SiRNA target sequence
ataagacatataattggcagt

SEQ ID NO: 243916 - DNA, 21 bp, Artificial sequence
  SiRNA target sequence
taagacatataattggcagtg

SEQ ID NO: 243917 - DNA, 21 bp, Artificial sequence
  SiRNA target sequence
aagacatataattggcagtga

SEQ ID NO: 243918 - DNA, 21 bp, Artificial sequence
  SiRNA target sequence
agacatataattggcagtgaa

SEQ ID NO: 243919 - DNA, 21 bp, Artificial sequence
  SiRNA target sequence
gacatataattggcagtgaaa

SEQ ID NO: 243920 - DNA, 21 bp, Artificial sequence
  SiRNA target sequence
acatataattggcagtgaaaa

SEQ ID NO: 243921 - DNA, 21 bp, Artificial sequence
  SiRNA target sequence
catataattggcagtgaaaag

SEQ ID NO: 243922 - DNA, 21 bp, Artificial sequence
  SiRNA target sequence
atataattggcagtgaaaaga

SEQ ID NO: 243923 - DNA, 21 bp, Artificial sequence
  SiRNA target sequence
tataattggcagtgaaaagaa

SEQ ID NO: 243924 - DNA, 21 bp, Artificial sequence
  SiRNA target sequence
ataattggcagtgaaaagaaa

SEQ ID NO: 243925 - DNA, 21 bp, Artificial sequence
  SiRNA target sequence
taattggcagtgaaaagaaaa

SEQ ID NO: 243926 - DNA, 21 bp, Artificial sequence
  SiRNA target sequence
aattggcagtgaaaagaaaag

SEQ ID NO: 243927 - DNA, 21 bp, Artificial sequence
  SiRNA target sequence
attggcagtgaaaagaaaagc

SEQ ID NO: 243928 - DNA, 21 bp, Artificial sequence
  SiRNA target sequence
ttggcagtgaaaagaaaagct

SEQ ID NO: 243929 - DNA, 21 bp, Artificial sequence
  SiRNA target sequence
tggcagtgaaaagaaaagctt

SEQ ID NO: 243930 - DNA, 21 bp, Artificial sequence
  SiRNA target sequence
ggcagtgaaaagaaaagcttt

SEQ ID NO: 243931 - DNA, 21 bp, Artificial sequence
  SiRNA target sequence
gcagtgaaaagaaaagcttta

SEQ ID NO: 243932 - DNA, 21 bp, Artificial sequence
  SiRNA target sequence
cagtgaaaagaaaagctttat

SEQ ID NO: 243933 - DNA, 21 bp, Artificial sequence
  SiRNA target sequence
agtgaaaagaaaagctttatg

SEQ ID NO: 243934 - DNA, 21 bp, Artificial sequence
  SiRNA target sequence
gtgaaaagaaaagctttatgt

SEQ ID NO: 243935 - DNA, 21 bp, Artificial sequence
  SiRNA target sequence
tgaaaagaaaagctttatgta

SEQ ID NO: 243936 - DNA, 21 bp, Artificial sequence
  SiRNA target sequence
gaaaagaaaagctttatgtag

SEQ ID NO: 243937 - DNA, 21 bp, Artificial sequence
  SiRNA target sequence
aaaagaaaagctttatgtagt

SEQ ID NO: 243938 - DNA, 21 bp, Artificial sequence
  SiRNA target sequence
aaagaaaagctttatgtagta

SEQ ID NO: 243939 - DNA, 21 bp, Artificial sequence
  SiRNA target sequence
aagaaaagctttatgtagtac

SEQ ID NO: 243940 - DNA, 21 bp, Artificial sequence
  SiRNA target sequence
agaaaagctttatgtagtaca

SEQ ID NO: 243941 - DNA, 21 bp, Artificial sequence
  SiRNA target sequence
gaaaagctttatgtagtacag

SEQ ID NO: 243942 - DNA, 21 bp, Artificial sequence
  SiRNA target sequence
aaaagctttatgtagtacagt

SEQ ID NO: 243943 - DNA, 21 bp, Artificial sequence
  SiRNA target sequence
aaagctttatgtagtacagtg

SEQ ID NO: 243944 - DNA, 21 bp, Artificial sequence
  SiRNA target sequence
aagctttatgtagtacagtga

SEQ ID NO: 243945 - DNA, 21 bp, Artificial sequence
  SiRNA target sequence
agctttatgtagtacagtgac

SEQ ID NO: 243946 - DNA, 21 bp, Artificial sequence
  SiRNA target sequence
gctttatgtagtacagtgacg

SEQ ID NO: 243947 - DNA, 21 bp, Artificial sequence
  SiRNA target sequence
ctttatgtagtacagtgacga

SEQ ID NO: 243948 - DNA, 21 bp, Artificial sequence
  SiRNA target sequence
tttatgtagtacagtgacgaa

SEQ ID NO: 243949 - DNA, 21 bp, Artificial sequence
  SiRNA target sequence
ttatgtagtacagtgacgaag

SEQ ID NO: 243950 - DNA, 21 bp, Artificial sequence
  SiRNA target sequence
tatgtagtacagtgacgaagg

SEQ ID NO: 243951 - DNA, 21 bp, Artificial sequence
  SiRNA target sequence
atgtagtacagtgacgaagga

SEQ ID NO: 243952 - DNA, 21 bp, Artificial sequence
  SiRNA target sequence
tgtagtacagtgacgaaggaa

SEQ ID NO: 243953 - DNA, 21 bp, Artificial sequence
  SiRNA target sequence
gtagtacagtgacgaaggaat

SEQ ID NO: 243954 - DNA, 21 bp, Artificial sequence
  SiRNA target sequence
tagtacagtgacgaaggaatt

SEQ ID NO: 243955 - DNA, 21 bp, Artificial sequence
  SiRNA target sequence
agtacagtgacgaaggaattt

SEQ ID NO: 243956 - DNA, 21 bp, Artificial sequence
  SiRNA target sequence
gtacagtgacgaaggaatttg

SEQ ID NO: 243957 - DNA, 21 bp, Artificial sequence
  SiRNA target sequence
tacagtgacgaaggaatttgt

SEQ ID NO: 243958 - DNA, 21 bp, Artificial sequence
  SiRNA target sequence
acagtgacgaaggaatttgtt

SEQ ID NO: 243959 - DNA, 21 bp, Artificial sequence
  SiRNA target sequence
cagtgacgaaggaatttgttt

SEQ ID NO: 243960 - DNA, 21 bp, Artificial sequence
  SiRNA target sequence
agtgacgaaggaatttgtttt

SEQ ID NO: 243961 - DNA, 21 bp, Artificial sequence
  SiRNA target sequence
gtgacgaaggaatttgttttg

SEQ ID NO: 243962 - DNA, 21 bp, Artificial sequence
  SiRNA target sequence
tgacgaaggaatttgttttgt

SEQ ID NO: 243963 - DNA, 21 bp, Artificial sequence
  SiRNA target sequence
gacgaaggaatttgttttgtc

SEQ ID NO: 243964 - DNA, 21 bp, Artificial sequence
  SiRNA target sequence
acgaaggaatttgttttgtca

SEQ ID NO: 243965 - DNA, 21 bp, Artificial sequence
  SiRNA target sequence
cgaaggaatttgttttgtcat

SEQ ID NO: 243966 - DNA, 21 bp, Artificial sequence
  SiRNA target sequence
gaaggaatttgttttgtcata

SEQ ID NO: 243967 - DNA, 21 bp, Artificial sequence
  SiRNA target sequence
aaggaatttgttttgtcataa

SEQ ID NO: 243968 - DNA, 21 bp, Artificial sequence
  SiRNA target sequence
aggaatttgttttgtcataat

SEQ ID NO: 243969 - DNA, 21 bp, Artificial sequence
  SiRNA target sequence
ggaatttgttttgtcataatc

SEQ ID NO: 243970 - DNA, 21 bp, Artificial sequence
  SiRNA target sequence
gaatttgttttgtcataatca

SEQ ID NO: 243971 - DNA, 21 bp, Artificial sequence
  SiRNA target sequence
aatttgttttgtcataatcac

SEQ ID NO: 243972 - DNA, 21 bp, Artificial sequence
  SiRNA target sequence
atttgttttgtcataatcacg

SEQ ID NO: 243973 - DNA, 21 bp, Artificial sequence
  SiRNA target sequence
tttgttttgtcataatcacga

SEQ ID NO: 243974 - DNA, 21 bp, Artificial sequence
  SiRNA target sequence
ttgttttgtcataatcacgat

SEQ ID NO: 243975 - DNA, 21 bp, Artificial sequence
  SiRNA target sequence
tgttttgtcataatcacgatt

SEQ ID NO: 243976 - DNA, 21 bp, Artificial sequence
  SiRNA target sequence
gttttgtcataatcacgattt

SEQ ID NO: 243977 - DNA, 21 bp, Artificial sequence
  SiRNA target sequence
ttttgtcataatcacgatttc

SEQ ID NO: 243978 - DNA, 21 bp, Artificial sequence
  SiRNA target sequence
tttgtcataatcacgatttct

SEQ ID NO: 243979 - DNA, 21 bp, Artificial sequence
  SiRNA target sequence
ttgtcataatcacgatttctc

SEQ ID NO: 243980 - DNA, 21 bp, Artificial sequence
  SiRNA target sequence
tgtcataatcacgatttctct

SEQ ID NO: 243981 - DNA, 21 bp, Artificial sequence
  SiRNA target sequence
gtcataatcacgatttctctg

SEQ ID NO: 243982 - DNA, 21 bp, Artificial sequence
  SiRNA target sequence
tcataatcacgatttctctgt

SEQ ID NO: 243983 - DNA, 21 bp, Artificial sequence
  SiRNA target sequence
cataatcacgatttctctgta

SEQ ID NO: 243984 - DNA, 21 bp, Artificial sequence
  SiRNA target sequence
ataatcacgatttctctgtaa

SEQ ID NO: 243985 - DNA, 21 bp, Artificial sequence
  SiRNA target sequence
taatcacgatttctctgtaaa

SEQ ID NO: 243986 - DNA, 21 bp, Artificial sequence
  SiRNA target sequence
aatcacgatttctctgtaaaa

SEQ ID NO: 243987 - DNA, 21 bp, Artificial sequence
  SiRNA target sequence
atcacgatttctctgtaaaat

SEQ ID NO: 243988 - DNA, 21 bp, Artificial sequence
  SiRNA target sequence
tcacgatttctctgtaaaatt

SEQ ID NO: 243989 - DNA, 21 bp, Artificial sequence
  SiRNA target sequence
cacgatttctctgtaaaattc

SEQ ID NO: 243990 - DNA, 21 bp, Artificial sequence
  SiRNA target sequence
acgatttctctgtaaaattcc

SEQ ID NO: 243991 - DNA, 21 bp, Artificial sequence
  SiRNA target sequence
cgatttctctgtaaaattcca

SEQ ID NO: 243992 - DNA, 21 bp, Artificial sequence
  SiRNA target sequence
gatttctctgtaaaattccaa

SEQ ID NO: 243993 - DNA, 21 bp, Artificial sequence
  SiRNA target sequence
atttctctgtaaaattccaat

SEQ ID NO: 243994 - DNA, 21 bp, Artificial sequence
  SiRNA target sequence
tttctctgtaaaattccaata

SEQ ID NO: 243995 - DNA, 21 bp, Artificial sequence
  SiRNA target sequence
ttctctgtaaaattccaataa

SEQ ID NO: 243996 - DNA, 21 bp, Artificial sequence
  SiRNA target sequence
tctctgtaaaattccaataat

SEQ ID NO: 243997 - DNA, 21 bp, Artificial sequence
  SiRNA target sequence
ctctgtaaaattccaataatg

SEQ ID NO: 243998 - DNA, 21 bp, Artificial sequence
  SiRNA target sequence
tctgtaaaattccaataatgt

SEQ ID NO: 243999 - DNA, 21 bp, Artificial sequence
  SiRNA target sequence
ctgtaaaattccaataatgtg

SEQ ID NO: 244000 - DNA, 21 bp, Artificial sequence
  SiRNA target sequence
tgtaaaattccaataatgtgt

SEQ ID NO: 244001 - DNA, 21 bp, Artificial sequence
  SiRNA target sequence
gtaaaattccaataatgtgtt

SEQ ID NO: 244002 - DNA, 21 bp, Artificial sequence
  SiRNA target sequence
taaaattccaataatgtgtta

SEQ ID NO: 244003 - DNA, 21 bp, Artificial sequence
  SiRNA target sequence
aaaattccaataatgtgttaa

SEQ ID NO: 244004 - DNA, 21 bp, Artificial sequence
  SiRNA target sequence
aaattccaataatgtgttaat

SEQ ID NO: 244005 - DNA, 21 bp, Artificial sequence
  SiRNA target sequence
aattccaataatgtgttaatc

SEQ ID NO: 244006 - DNA, 21 bp, Artificial sequence
  SiRNA target sequence
attccaataatgtgttaatca

SEQ ID NO: 244007 - DNA, 21 bp, Artificial sequence
  SiRNA target sequence
ttccaataatgtgttaatcac

SEQ ID NO: 244008 - DNA, 21 bp, Artificial sequence
  SiRNA target sequence
tccaataatgtgttaatcaca

SEQ ID NO: 244009 - DNA, 21 bp, Artificial sequence
  SiRNA target sequence
ccaataatgtgttaatcacac

SEQ ID NO: 244010 - DNA, 21 bp, Artificial sequence
  SiRNA target sequence
caataatgtgttaatcacaca

SEQ ID NO: 244011 - DNA, 21 bp, Artificial sequence
  SiRNA target sequence
aataatgtgttaatcacacat

SEQ ID NO: 244012 - DNA, 21 bp, Artificial sequence
  SiRNA target sequence
ataatgtgttaatcacacatg

SEQ ID NO: 244013 - DNA, 21 bp, Artificial sequence
  SiRNA target sequence
taatgtgttaatcacacatgc

SEQ ID NO: 244014 - DNA, 21 bp, Artificial sequence
  SiRNA target sequence
aatgtgttaatcacacatgcc

SEQ ID NO: 244015 - DNA, 21 bp, Artificial sequence
  SiRNA target sequence
atgtgttaatcacacatgcca

SEQ ID NO: 244016 - DNA, 21 bp, Artificial sequence
  SiRNA target sequence
tgtgttaatcacacatgccat

SEQ ID NO: 244017 - DNA, 21 bp, Artificial sequence
  SiRNA target sequence
gtgttaatcacacatgccatt

SEQ ID NO: 244018 - DNA, 21 bp, Artificial sequence
  SiRNA target sequence
tgttaatcacacatgccatta

SEQ ID NO: 244019 - DNA, 21 bp, Artificial sequence
  SiRNA target sequence
gttaatcacacatgccattaa

SEQ ID NO: 244020 - DNA, 21 bp, Artificial sequence
  SiRNA target sequence
ttaatcacacatgccattaaa

SEQ ID NO: 244021 - DNA, 21 bp, Artificial sequence
  SiRNA target sequence
taatcacacatgccattaaaa

SEQ ID NO: 244022 - DNA, 21 bp, Artificial sequence
  SiRNA target sequence
aatcacacatgccattaaaaa

SEQ ID NO: 244023 - DNA, 21 bp, Artificial sequence
  SiRNA target sequence
atcacacatgccattaaaaat

SEQ ID NO: 244024 - DNA, 21 bp, Artificial sequence
  SiRNA target sequence
tcacacatgccattaaaaatg

SEQ ID NO: 244025 - DNA, 21 bp, Artificial sequence
  SiRNA target sequence
cacacatgccattaaaaatgt

SEQ ID NO: 244026 - DNA, 21 bp, Artificial sequence
  SiRNA target sequence
acacatgccattaaaaatgta

SEQ ID NO: 244027 - DNA, 21 bp, Artificial sequence
  SiRNA target sequence
cacatgccattaaaaatgtaa

SEQ ID NO: 244028 - DNA, 21 bp, Artificial sequence
  SiRNA target sequence
acatgccattaaaaatgtaag

SEQ ID NO: 244029 - DNA, 21 bp, Artificial sequence
  SiRNA target sequence
catgccattaaaaatgtaagt

SEQ ID NO: 244030 - DNA, 21 bp, Artificial sequence
  SiRNA target sequence
atgccattaaaaatgtaagtg

SEQ ID NO: 244031 - DNA, 21 bp, Artificial sequence
  SiRNA target sequence
tgccattaaaaatgtaagtga

SEQ ID NO: 244032 - DNA, 21 bp, Artificial sequence
  SiRNA target sequence
gccattaaaaatgtaagtgac

SEQ ID NO: 244033 - DNA, 21 bp, Artificial sequence
  SiRNA target sequence
ccattaaaaatgtaagtgaca

SEQ ID NO: 244034 - DNA, 21 bp, Artificial sequence
  SiRNA target sequence
cattaaaaatgtaagtgacaa

SEQ ID NO: 244035 - DNA, 21 bp, Artificial sequence
  SiRNA target sequence
attaaaaatgtaagtgacaat

SEQ ID NO: 244036 - DNA, 21 bp, Artificial sequence
  SiRNA target sequence
ttaaaaatgtaagtgacaata

SEQ ID NO: 244037 - DNA, 21 bp, Artificial sequence
  SiRNA target sequence
taaaaatgtaagtgacaataa

SEQ ID NO: 244038 - DNA, 21 bp, Artificial sequence
  SiRNA target sequence
aaaaatgtaagtgacaataat

SEQ ID NO: 244039 - DNA, 21 bp, Artificial sequence
  SiRNA target sequence
aaaatgtaagtgacaataata

SEQ ID NO: 244040 - DNA, 21 bp, Artificial sequence
  SiRNA target sequence
aaatgtaagtgacaataatat

SEQ ID NO: 244041 - DNA, 21 bp, Artificial sequence
  SiRNA target sequence
aatgtaagtgacaataatatt

SEQ ID NO: 244042 - DNA, 21 bp, Artificial sequence
  SiRNA target sequence
atgtaagtgacaataatattt

SEQ ID NO: 244043 - DNA, 21 bp, Artificial sequence
  SiRNA target sequence
tgtaagtgacaataatatttt

SEQ ID NO: 244044 - DNA, 21 bp, Artificial sequence
  SiRNA target sequence
gtaagtgacaataatattttt

SEQ ID NO: 244045 - DNA, 21 bp, Artificial sequence
  SiRNA target sequence
taagtgacaataatattttta

SEQ ID NO: 244046 - DNA, 21 bp, Artificial sequence
  SiRNA target sequence
aagtgacaataatatttttac

SEQ ID NO: 244047 - DNA, 21 bp, Artificial sequence
  SiRNA target sequence
agtgacaataatatttttact

SEQ ID NO: 244048 - DNA, 21 bp, Artificial sequence
  SiRNA target sequence
gtgacaataatatttttactt

SEQ ID NO: 244049 - DNA, 21 bp, Artificial sequence
  SiRNA target sequence
tgacaataatatttttacttt

SEQ ID NO: 244050 - DNA, 21 bp, Artificial sequence
  SiRNA target sequence
gacaataatatttttactttt

SEQ ID NO: 244051 - DNA, 21 bp, Artificial sequence
  SiRNA target sequence
acaataatatttttacttttg

SEQ ID NO: 244052 - DNA, 21 bp, Artificial sequence
  SiRNA target sequence
caataatatttttacttttgg

SEQ ID NO: 244053 - DNA, 21 bp, Artificial sequence
  SiRNA target sequence
aataatatttttacttttggg

SEQ ID NO: 244054 - DNA, 21 bp, Artificial sequence
  SiRNA target sequence
ataatatttttacttttggga

SEQ ID NO: 244055 - DNA, 21 bp, Artificial sequence
  SiRNA target sequence
taatatttttacttttgggaa

SEQ ID NO: 244056 - DNA, 21 bp, Artificial sequence
  SiRNA target sequence
aatatttttacttttgggaat

SEQ ID NO: 244057 - DNA, 21 bp, Artificial sequence
  SiRNA target sequence
atatttttacttttgggaatt

SEQ ID NO: 244058 - DNA, 21 bp, Artificial sequence
  SiRNA target sequence
tatttttacttttgggaattt

SEQ ID NO: 244059 - DNA, 21 bp, Artificial sequence
  SiRNA target sequence
atttttacttttgggaatttt

SEQ ID NO: 244060 - DNA, 21 bp, Artificial sequence
  SiRNA target sequence
tttttacttttgggaattttt

SEQ ID NO: 244061 - DNA, 21 bp, Artificial sequence
  SiRNA target sequence
ttttacttttgggaatttttt

SEQ ID NO: 244062 - DNA, 21 bp, Artificial sequence
  SiRNA target sequence
tttacttttgggaattttttt

SEQ ID NO: 244063 - DNA, 21 bp, Artificial sequence
  SiRNA target sequence
ttacttttgggaatttttttg

SEQ ID NO: 244064 - DNA, 21 bp, Artificial sequence
  SiRNA target sequence
tacttttgggaatttttttgt

SEQ ID NO: 244065 - DNA, 21 bp, Artificial sequence
  SiRNA target sequence
acttttgggaatttttttgtc

SEQ ID NO: 244066 - DNA, 21 bp, Artificial sequence
  SiRNA target sequence
cttttgggaatttttttgtct

SEQ ID NO: 244067 - DNA, 21 bp, Artificial sequence
  SiRNA target sequence
ttttgggaatttttttgtctt

SEQ ID NO: 244068 - DNA, 21 bp, Artificial sequence
  SiRNA target sequence
tttgggaatttttttgtctta

SEQ ID NO: 244069 - DNA, 21 bp, Artificial sequence
  SiRNA target sequence
ttgggaatttttttgtcttag

SEQ ID NO: 244070 - DNA, 21 bp, Artificial sequence
  SiRNA target sequence
tgggaatttttttgtcttagt

SEQ ID NO: 244071 - DNA, 21 bp, Artificial sequence
  SiRNA target sequence
gggaatttttttgtcttagtc

SEQ ID NO: 244072 - DNA, 21 bp, Artificial sequence
  SiRNA target sequence
ggaatttttttgtcttagtca

SEQ ID NO: 244073 - DNA, 21 bp, Artificial sequence
  SiRNA target sequence
gaatttttttgtcttagtcat

SEQ ID NO: 244074 - DNA, 22 bp, Artificial sequence
  SiRNA target sequence
ttaattaaaatcaacatctatc

SEQ ID NO: 244075 - DNA, 22 bp, Artificial sequence
  SiRNA target sequence
taattaaaatcaacatctatct

SEQ ID NO: 244076 - DNA, 22 bp, Artificial sequence
  SiRNA target sequence
aattaaaatcaacatctatctc

SEQ ID NO: 244077 - DNA, 22 bp, Artificial sequence
  SiRNA target sequence
attaaaatcaacatctatctca

SEQ ID NO: 244078 - DNA, 22 bp, Artificial sequence
  SiRNA target sequence
ttaaaatcaacatctatctcag

SEQ ID NO: 244079 - DNA, 22 bp, Artificial sequence
  SiRNA target sequence
taaaatcaacatctatctcaga

SEQ ID NO: 244080 - DNA, 22 bp, Artificial sequence
  SiRNA target sequence
aaaatcaacatctatctcagaa

SEQ ID NO: 244081 - DNA, 22 bp, Artificial sequence
  SiRNA target sequence
aaatcaacatctatctcagaat

SEQ ID NO: 244082 - DNA, 22 bp, Artificial sequence
  SiRNA target sequence
aatcaacatctatctcagaatt

SEQ ID NO: 244083 - DNA, 22 bp, Artificial sequence
  SiRNA target sequence
atcaacatctatctcagaattt

SEQ ID NO: 244084 - DNA, 22 bp, Artificial sequence
  SiRNA target sequence
tcaacatctatctcagaatttt

SEQ ID NO: 244085 - DNA, 22 bp, Artificial sequence
  SiRNA target sequence
caacatctatctcagaattttg

SEQ ID NO: 244086 - DNA, 22 bp, Artificial sequence
  SiRNA target sequence
aacatctatctcagaattttgt

SEQ ID NO: 244087 - DNA, 22 bp, Artificial sequence
  SiRNA target sequence
acatctatctcagaattttgtt

SEQ ID NO: 244088 - DNA, 22 bp, Artificial sequence
  SiRNA target sequence
catctatctcagaattttgttc

SEQ ID NO: 244089 - DNA, 22 bp, Artificial sequence
  SiRNA target sequence
atctatctcagaattttgttca

SEQ ID NO: 244090 - DNA, 22 bp, Artificial sequence
  SiRNA target sequence
tctatctcagaattttgttcaa

SEQ ID NO: 244091 - DNA, 22 bp, Artificial sequence
  SiRNA target sequence
ctatctcagaattttgttcaat

SEQ ID NO: 244092 - DNA, 22 bp, Artificial sequence
  SiRNA target sequence
tatctcagaattttgttcaatt

SEQ ID NO: 244093 - DNA, 22 bp, Artificial sequence
  SiRNA target sequence
atctcagaattttgttcaattg

SEQ ID NO: 244094 - DNA, 22 bp, Artificial sequence
  SiRNA target sequence
tctcagaattttgttcaattga

SEQ ID NO: 244095 - DNA, 22 bp, Artificial sequence
  SiRNA target sequence
ctcagaattttgttcaattgat

SEQ ID NO: 244096 - DNA, 22 bp, Artificial sequence
  SiRNA target sequence
tcagaattttgttcaattgatt

SEQ ID NO: 244097 - DNA, 22 bp, Artificial sequence
  SiRNA target sequence
cagaattttgttcaattgattc

SEQ ID NO: 244098 - DNA, 22 bp, Artificial sequence
  SiRNA target sequence
agaattttgttcaattgattca

SEQ ID NO: 244099 - DNA, 22 bp, Artificial sequence
  SiRNA target sequence
gaattttgttcaattgattcat

SEQ ID NO: 244100 - DNA, 22 bp, Artificial sequence
  SiRNA target sequence
aattttgttcaattgattcatt

SEQ ID NO: 244101 - DNA, 22 bp, Artificial sequence
  SiRNA target sequence
attttgttcaattgattcatta

SEQ ID NO: 244102 - DNA, 22 bp, Artificial sequence
  SiRNA target sequence
ttttgttcaattgattcattat

SEQ ID NO: 244103 - DNA, 22 bp, Artificial sequence
  SiRNA target sequence
tttgttcaattgattcattata

SEQ ID NO: 244104 - DNA, 22 bp, Artificial sequence
  SiRNA target sequence
ttgttcaattgattcattatat

SEQ ID NO: 244105 - DNA, 22 bp, Artificial sequence
  SiRNA target sequence
tgttcaattgattcattatatt

SEQ ID NO: 244106 - DNA, 22 bp, Artificial sequence
  SiRNA target sequence
gttcaattgattcattatattt

SEQ ID NO: 244107 - DNA, 22 bp, Artificial sequence
  SiRNA target sequence
ttcaattgattcattatatttt

SEQ ID NO: 244108 - DNA, 22 bp, Artificial sequence
  SiRNA target sequence
tcaattgattcattatattttt

SEQ ID NO: 244109 - DNA, 22 bp, Artificial sequence
  SiRNA target sequence
caattgattcattatatttttt

SEQ ID NO: 244110 - DNA, 22 bp, Artificial sequence
  SiRNA target sequence
aattgattcattatatttttta

SEQ ID NO: 244111 - DNA, 22 bp, Artificial sequence
  SiRNA target sequence
attgattcattatattttttac

SEQ ID NO: 244112 - DNA, 22 bp, Artificial sequence
  SiRNA target sequence
ttgattcattatattttttact

SEQ ID NO: 244113 - DNA, 22 bp, Artificial sequence
  SiRNA target sequence
tgattcattatattttttactt

SEQ ID NO: 244114 - DNA, 22 bp, Artificial sequence
  SiRNA target sequence
gattcattatattttttactta

SEQ ID NO: 244115 - DNA, 22 bp, Artificial sequence
  SiRNA target sequence
attcattatattttttacttaa

SEQ ID NO: 244116 - DNA, 22 bp, Artificial sequence
  SiRNA target sequence
ttcattatattttttacttaaa

SEQ ID NO: 244117 - DNA, 22 bp, Artificial sequence
  SiRNA target sequence
tcattatattttttacttaaat

SEQ ID NO: 244118 - DNA, 22 bp, Artificial sequence
  SiRNA target sequence
cattatattttttacttaaata

SEQ ID NO: 244119 - DNA, 22 bp, Artificial sequence
  SiRNA target sequence
attatattttttacttaaataa

SEQ ID NO: 244120 - DNA, 22 bp, Artificial sequence
  SiRNA target sequence
ttatattttttacttaaataac

SEQ ID NO: 244121 - DNA, 22 bp, Artificial sequence
  SiRNA target sequence
tatattttttacttaaataaca

SEQ ID NO: 244122 - DNA, 22 bp, Artificial sequence
  SiRNA target sequence
atattttttacttaaataacag

SEQ ID NO: 244123 - DNA, 22 bp, Artificial sequence
  SiRNA target sequence
tattttttacttaaataacaga

SEQ ID NO: 244124 - DNA, 22 bp, Artificial sequence
  SiRNA target sequence
attttttacttaaataacagac

SEQ ID NO: 244125 - DNA, 22 bp, Artificial sequence
  SiRNA target sequence
ttttttacttaaataacagaca

SEQ ID NO: 244126 - DNA, 22 bp, Artificial sequence
  SiRNA target sequence
tttttacttaaataacagacac

SEQ ID NO: 244127 - DNA, 22 bp, Artificial sequence
  SiRNA target sequence
ttttacttaaataacagacact

SEQ ID NO: 244128 - DNA, 22 bp, Artificial sequence
  SiRNA target sequence
tttacttaaataacagacactc

SEQ ID NO: 244129 - DNA, 22 bp, Artificial sequence
  SiRNA target sequence
ttacttaaataacagacactcc

SEQ ID NO: 244130 - DNA, 22 bp, Artificial sequence
  SiRNA target sequence
tacttaaataacagacactcct

SEQ ID NO: 244131 - DNA, 22 bp, Artificial sequence
  SiRNA target sequence
acttaaataacagacactcctg

SEQ ID NO: 244132 - DNA, 22 bp, Artificial sequence
  SiRNA target sequence
cttaaataacagacactcctga

SEQ ID NO: 244133 - DNA, 22 bp, Artificial sequence
  SiRNA target sequence
ttaaataacagacactcctgat

SEQ ID NO: 244134 - DNA, 22 bp, Artificial sequence
  SiRNA target sequence
taaataacagacactcctgatc

SEQ ID NO: 244135 - DNA, 22 bp, Artificial sequence
  SiRNA target sequence
aaataacagacactcctgatcc

SEQ ID NO: 244136 - DNA, 22 bp, Artificial sequence
  SiRNA target sequence
aataacagacactcctgatcca

SEQ ID NO: 244137 - DNA, 22 bp, Artificial sequence
  SiRNA target sequence
ataacagacactcctgatccac

SEQ ID NO: 244138 - DNA, 22 bp, Artificial sequence
  SiRNA target sequence
taacagacactcctgatccaca

SEQ ID NO: 244139 - DNA, 22 bp, Artificial sequence
  SiRNA target sequence
aacagacactcctgatccacaa

SEQ ID NO: 244140 - DNA, 22 bp, Artificial sequence
  SiRNA target sequence
acagacactcctgatccacaaa

SEQ ID NO: 244141 - DNA, 22 bp, Artificial sequence
  SiRNA target sequence
cagacactcctgatccacaaaa

SEQ ID NO: 244142 - DNA, 22 bp, Artificial sequence
  SiRNA target sequence
agacactcctgatccacaaaaa

SEQ ID NO: 244143 - DNA, 22 bp, Artificial sequence
  SiRNA target sequence
gacactcctgatccacaaaaaa

SEQ ID NO: 244144 - DNA, 22 bp, Artificial sequence
  SiRNA target sequence
acactcctgatccacaaaaaat

SEQ ID NO: 244145 - DNA, 22 bp, Artificial sequence
  SiRNA target sequence
cactcctgatccacaaaaaatt

SEQ ID NO: 244146 - DNA, 22 bp, Artificial sequence
  SiRNA target sequence
actcctgatccacaaaaaattt

SEQ ID NO: 244147 - DNA, 22 bp, Artificial sequence
  SiRNA target sequence
ctcctgatccacaaaaaatttg

SEQ ID NO: 244148 - DNA, 22 bp, Artificial sequence
  SiRNA target sequence
tcctgatccacaaaaaatttgc

SEQ ID NO: 244149 - DNA, 22 bp, Artificial sequence
  SiRNA target sequence
cctgatccacaaaaaatttgca

SEQ ID NO: 244150 - DNA, 22 bp, Artificial sequence
  SiRNA target sequence
ctgatccacaaaaaatttgcaa

SEQ ID NO: 244151 - DNA, 22 bp, Artificial sequence
  SiRNA target sequence
tgatccacaaaaaatttgcaaa

SEQ ID NO: 244152 - DNA, 22 bp, Artificial sequence
  SiRNA target sequence
gatccacaaaaaatttgcaaat

SEQ ID NO: 244153 - DNA, 22 bp, Artificial sequence
  SiRNA target sequence
atccacaaaaaatttgcaaata

SEQ ID NO: 244154 - DNA, 22 bp, Artificial sequence
  SiRNA target sequence
tccacaaaaaatttgcaaatat

SEQ ID NO: 244155 - DNA, 22 bp, Artificial sequence
  SiRNA target sequence
ccacaaaaaatttgcaaatatt

SEQ ID NO: 244156 - DNA, 22 bp, Artificial sequence
  SiRNA target sequence
cacaaaaaatttgcaaatatta

SEQ ID NO: 244157 - DNA, 22 bp, Artificial sequence
  SiRNA target sequence
acaaaaaatttgcaaatattaa

SEQ ID NO: 244158 - DNA, 22 bp, Artificial sequence
  SiRNA target sequence
caaaaaatttgcaaatattaaa

SEQ ID NO: 244159 - DNA, 22 bp, Artificial sequence
  SiRNA target sequence
aaaaaatttgcaaatattaaaa

SEQ ID NO: 244160 - DNA, 22 bp, Artificial sequence
  SiRNA target sequence
aaaaatttgcaaatattaaaaa

SEQ ID NO: 244161 - DNA, 22 bp, Artificial sequence
  SiRNA target sequence
aaaatttgcaaatattaaaaat

SEQ ID NO: 244162 - DNA, 22 bp, Artificial sequence
  SiRNA target sequence
aaatttgcaaatattaaaaata

SEQ ID NO: 244163 - DNA, 22 bp, Artificial sequence
  SiRNA target sequence
aatttgcaaatattaaaaatat

SEQ ID NO: 244164 - DNA, 22 bp, Artificial sequence
  SiRNA target sequence
atttgcaaatattaaaaatata

SEQ ID NO: 244165 - DNA, 22 bp, Artificial sequence
  SiRNA target sequence
tttgcaaatattaaaaatataa

SEQ ID NO: 244166 - DNA, 22 bp, Artificial sequence
  SiRNA target sequence
ttgcaaatattaaaaatataaa

SEQ ID NO: 244167 - DNA, 22 bp, Artificial sequence
  SiRNA target sequence
tgcaaatattaaaaatataaaa

SEQ ID NO: 244168 - DNA, 22 bp, Artificial sequence
  SiRNA target sequence
gcaaatattaaaaatataaaag

SEQ ID NO: 244169 - DNA, 22 bp, Artificial sequence
  SiRNA target sequence
caaatattaaaaatataaaaga

SEQ ID NO: 244170 - DNA, 22 bp, Artificial sequence
  SiRNA target sequence
aaatattaaaaatataaaagac

SEQ ID NO: 244171 - DNA, 22 bp, Artificial sequence
  SiRNA target sequence
aatattaaaaatataaaagaca

SEQ ID NO: 244172 - DNA, 22 bp, Artificial sequence
  SiRNA target sequence
atattaaaaatataaaagacac

SEQ ID NO: 244173 - DNA, 22 bp, Artificial sequence
  SiRNA target sequence
tattaaaaatataaaagacacg

SEQ ID NO: 244174 - DNA, 22 bp, Artificial sequence
  SiRNA target sequence
attaaaaatataaaagacacgt

SEQ ID NO: 244175 - DNA, 22 bp, Artificial sequence
  SiRNA target sequence
ttaaaaatataaaagacacgta

SEQ ID NO: 244176 - DNA, 22 bp, Artificial sequence
  SiRNA target sequence
taaaaatataaaagacacgtat

SEQ ID NO: 244177 - DNA, 22 bp, Artificial sequence
  SiRNA target sequence
aaaaatataaaagacacgtatg

SEQ ID NO: 244178 - DNA, 22 bp, Artificial sequence
  SiRNA target sequence
aaaatataaaagacacgtatga

SEQ ID NO: 244179 - DNA, 22 bp, Artificial sequence
  SiRNA target sequence
aaatataaaagacacgtatgat

SEQ ID NO: 244180 - DNA, 22 bp, Artificial sequence
  SiRNA target sequence
aatataaaagacacgtatgata

SEQ ID NO: 244181 - DNA, 22 bp, Artificial sequence
  SiRNA target sequence
atataaaagacacgtatgatac

SEQ ID NO: 244182 - DNA, 22 bp, Artificial sequence
  SiRNA target sequence
tataaaagacacgtatgatact

SEQ ID NO: 244183 - DNA, 22 bp, Artificial sequence
  SiRNA target sequence
ataaaagacacgtatgatactt

SEQ ID NO: 244184 - DNA, 22 bp, Artificial sequence
  SiRNA target sequence
taaaagacacgtatgatacttg

SEQ ID NO: 244185 - DNA, 22 bp, Artificial sequence
  SiRNA target sequence
aaaagacacgtatgatacttgt

SEQ ID NO: 244186 - DNA, 22 bp, Artificial sequence
  SiRNA target sequence
aaagacacgtatgatacttgtc

SEQ ID NO: 244187 - DNA, 22 bp, Artificial sequence
  SiRNA target sequence
aagacacgtatgatacttgtct

SEQ ID NO: 244188 - DNA, 22 bp, Artificial sequence
  SiRNA target sequence
agacacgtatgatacttgtcta

SEQ ID NO: 244189 - DNA, 22 bp, Artificial sequence
  SiRNA target sequence
gacacgtatgatacttgtctaa

SEQ ID NO: 244190 - DNA, 22 bp, Artificial sequence
  SiRNA target sequence
acacgtatgatacttgtctaat

SEQ ID NO: 244191 - DNA, 22 bp, Artificial sequence
  SiRNA target sequence
cacgtatgatacttgtctaata

SEQ ID NO: 244192 - DNA, 22 bp, Artificial sequence
  SiRNA target sequence
acgtatgatacttgtctaatat

SEQ ID NO: 244193 - DNA, 22 bp, Artificial sequence
  SiRNA target sequence
cgtatgatacttgtctaatatc

SEQ ID NO: 244194 - DNA, 22 bp, Artificial sequence
  SiRNA target sequence
gtatgatacttgtctaatatct

SEQ ID NO: 244195 - DNA, 22 bp, Artificial sequence
  SiRNA target sequence
tatgatacttgtctaatatctg

SEQ ID NO: 244196 - DNA, 22 bp, Artificial sequence
  SiRNA target sequence
atgatacttgtctaatatctgg

SEQ ID NO: 244197 - DNA, 22 bp, Artificial sequence
  SiRNA target sequence
tgatacttgtctaatatctgga

SEQ ID NO: 244198 - DNA, 22 bp, Artificial sequence
  SiRNA target sequence
gatacttgtctaatatctggaa

SEQ ID NO: 244199 - DNA, 22 bp, Artificial sequence
  SiRNA target sequence
atacttgtctaatatctggaat

SEQ ID NO: 244200 - DNA, 22 bp, Artificial sequence
  SiRNA target sequence
tacttgtctaatatctggaatt

SEQ ID NO: 244201 - DNA, 22 bp, Artificial sequence
  SiRNA target sequence
acttgtctaatatctggaattt

SEQ ID NO: 244202 - DNA, 22 bp, Artificial sequence
  SiRNA target sequence
cttgtctaatatctggaatttc

SEQ ID NO: 244203 - DNA, 22 bp, Artificial sequence
  SiRNA target sequence
ttgtctaatatctggaatttct

SEQ ID NO: 244204 - DNA, 22 bp, Artificial sequence
  SiRNA target sequence
tgtctaatatctggaatttcta

SEQ ID NO: 244205 - DNA, 22 bp, Artificial sequence
  SiRNA target sequence
gtctaatatctggaatttctat

SEQ ID NO: 244206 - DNA, 22 bp, Artificial sequence
  SiRNA target sequence
tctaatatctggaatttctata

SEQ ID NO: 244207 - DNA, 22 bp, Artificial sequence
  SiRNA target sequence
ctaatatctggaatttctataa

SEQ ID NO: 244208 - DNA, 22 bp, Artificial sequence
  SiRNA target sequence
taatatctggaatttctataaa

SEQ ID NO: 244209 - DNA, 22 bp, Artificial sequence
  SiRNA target sequence
aatatctggaatttctataaac

SEQ ID NO: 244210 - DNA, 22 bp, Artificial sequence
  SiRNA target sequence
atatctggaatttctataaacg

SEQ ID NO: 244211 - DNA, 22 bp, Artificial sequence
  SiRNA target sequence
tatctggaatttctataaacgt

SEQ ID NO: 244212 - DNA, 22 bp, Artificial sequence
  SiRNA target sequence
atctggaatttctataaacgtc

SEQ ID NO: 244213 - DNA, 22 bp, Artificial sequence
  SiRNA target sequence
tctggaatttctataaacgtca

SEQ ID NO: 244214 - DNA, 22 bp, Artificial sequence
  SiRNA target sequence
ctggaatttctataaacgtcaa

SEQ ID NO: 244215 - DNA, 22 bp, Artificial sequence
  SiRNA target sequence
tggaatttctataaacgtcaaa

SEQ ID NO: 244216 - DNA, 22 bp, Artificial sequence
  SiRNA target sequence
ggaatttctataaacgtcaaaa

SEQ ID NO: 244217 - DNA, 22 bp, Artificial sequence
  SiRNA target sequence
gaatttctataaacgtcaaaaa

SEQ ID NO: 244218 - DNA, 22 bp, Artificial sequence
  SiRNA target sequence
aatttctataaacgtcaaaaaa

SEQ ID NO: 244219 - DNA, 22 bp, Artificial sequence
  SiRNA target sequence
atttctataaacgtcaaaaaag

SEQ ID NO: 244220 - DNA, 22 bp, Artificial sequence
  SiRNA target sequence
tttctataaacgtcaaaaaagt

SEQ ID NO: 244221 - DNA, 22 bp, Artificial sequence
  SiRNA target sequence
ttctataaacgtcaaaaaagtt

SEQ ID NO: 244222 - DNA, 22 bp, Artificial sequence
  SiRNA target sequence
tctataaacgtcaaaaaagttc

SEQ ID NO: 244223 - DNA, 22 bp, Artificial sequence
  SiRNA target sequence
ctataaacgtcaaaaaagttcc

SEQ ID NO: 244224 - DNA, 22 bp, Artificial sequence
  SiRNA target sequence
tataaacgtcaaaaaagttcca

SEQ ID NO: 244225 - DNA, 22 bp, Artificial sequence
  SiRNA target sequence
ataaacgtcaaaaaagttccat

SEQ ID NO: 244226 - DNA, 22 bp, Artificial sequence
  SiRNA target sequence
taaacgtcaaaaaagttccata

SEQ ID NO: 244227 - DNA, 22 bp, Artificial sequence
  SiRNA target sequence
aaacgtcaaaaaagttccatat

SEQ ID NO: 244228 - DNA, 22 bp, Artificial sequence
  SiRNA target sequence
aacgtcaaaaaagttccatata

SEQ ID NO: 244229 - DNA, 22 bp, Artificial sequence
  SiRNA target sequence
acgtcaaaaaagttccatataa

SEQ ID NO: 244230 - DNA, 22 bp, Artificial sequence
  SiRNA target sequence
cgtcaaaaaagttccatataaa

SEQ ID NO: 244231 - DNA, 22 bp, Artificial sequence
  SiRNA target sequence
gtcaaaaaagttccatataaag

SEQ ID NO: 244232 - DNA, 22 bp, Artificial sequence
  SiRNA target sequence
tcaaaaaagttccatataaaga

SEQ ID NO: 244233 - DNA, 22 bp, Artificial sequence
  SiRNA target sequence
caaaaaagttccatataaagag

SEQ ID NO: 244234 - DNA, 22 bp, Artificial sequence
  SiRNA target sequence
aaaaaagttccatataaagaga

SEQ ID NO: 244235 - DNA, 22 bp, Artificial sequence
  SiRNA target sequence
aaaaagttccatataaagagat

SEQ ID NO: 244236 - DNA, 22 bp, Artificial sequence
  SiRNA target sequence
aaaagttccatataaagagata

SEQ ID NO: 244237 - DNA, 22 bp, Artificial sequence
  SiRNA target sequence
aaagttccatataaagagataa

SEQ ID NO: 244238 - DNA, 22 bp, Artificial sequence
  SiRNA target sequence
aagttccatataaagagataat

SEQ ID NO: 244239 - DNA, 22 bp, Artificial sequence
  SiRNA target sequence
agttccatataaagagataata

SEQ ID NO: 244240 - DNA, 22 bp, Artificial sequence
  SiRNA target sequence
gttccatataaagagataatag

SEQ ID NO: 244241 - DNA, 22 bp, Artificial sequence
  SiRNA target sequence
ttccatataaagagataataga

SEQ ID NO: 244242 - DNA, 22 bp, Artificial sequence
  SiRNA target sequence
tccatataaagagataatagat

SEQ ID NO: 244243 - DNA, 22 bp, Artificial sequence
  SiRNA target sequence
ccatataaagagataatagatt

SEQ ID NO: 244244 - DNA, 22 bp, Artificial sequence
  SiRNA target sequence
catataaagagataatagattt

SEQ ID NO: 244245 - DNA, 22 bp, Artificial sequence
  SiRNA target sequence
atataaagagataatagattta

SEQ ID NO: 244246 - DNA, 22 bp, Artificial sequence
  SiRNA target sequence
tataaagagataatagatttac

SEQ ID NO: 244247 - DNA, 22 bp, Artificial sequence
  SiRNA target sequence
ataaagagataatagatttacc

SEQ ID NO: 244248 - DNA, 22 bp, Artificial sequence
  SiRNA target sequence
taaagagataatagatttacca

SEQ ID NO: 244249 - DNA, 22 bp, Artificial sequence
  SiRNA target sequence
aaagagataatagatttaccaa

SEQ ID NO: 244250 - DNA, 22 bp, Artificial sequence
  SiRNA target sequence
aagagataatagatttaccaat

SEQ ID NO: 244251 - DNA, 22 bp, Artificial sequence
  SiRNA target sequence
agagataatagatttaccaatt

SEQ ID NO: 244252 - DNA, 22 bp, Artificial sequence
  SiRNA target sequence
gagataatagatttaccaattt

SEQ ID NO: 244253 - DNA, 22 bp, Artificial sequence
  SiRNA target sequence
agataatagatttaccaatttt

SEQ ID NO: 244254 - DNA, 22 bp, Artificial sequence
  SiRNA target sequence
gataatagatttaccaattttg

SEQ ID NO: 244255 - DNA, 22 bp, Artificial sequence
  SiRNA target sequence
ataatagatttaccaattttga

SEQ ID NO: 244256 - DNA, 22 bp, Artificial sequence
  SiRNA target sequence
taatagatttaccaattttgat

SEQ ID NO: 244257 - DNA, 22 bp, Artificial sequence
  SiRNA target sequence
aatagatttaccaattttgata

SEQ ID NO: 244258 - DNA, 22 bp, Artificial sequence
  SiRNA target sequence
atagatttaccaattttgatac

SEQ ID NO: 244259 - DNA, 22 bp, Artificial sequence
  SiRNA target sequence
tagatttaccaattttgataca

SEQ ID NO: 244260 - DNA, 22 bp, Artificial sequence
  SiRNA target sequence
agatttaccaattttgatacat

SEQ ID NO: 244261 - DNA, 22 bp, Artificial sequence
  SiRNA target sequence
gatttaccaattttgatacata

SEQ ID NO: 244262 - DNA, 22 bp, Artificial sequence
  SiRNA target sequence
atttaccaattttgatacatac

SEQ ID NO: 244263 - DNA, 22 bp, Artificial sequence
  SiRNA target sequence
tttaccaattttgatacataca

SEQ ID NO: 244264 - DNA, 22 bp, Artificial sequence
  SiRNA target sequence
ttaccaattttgatacatacac

SEQ ID NO: 244265 - DNA, 22 bp, Artificial sequence
  SiRNA target sequence
taccaattttgatacatacacc

SEQ ID NO: 244266 - DNA, 22 bp, Artificial sequence
  SiRNA target sequence
accaattttgatacatacacca

SEQ ID NO: 244267 - DNA, 22 bp, Artificial sequence
  SiRNA target sequence
ccaattttgatacatacaccat

SEQ ID NO: 244268 - DNA, 22 bp, Artificial sequence
  SiRNA target sequence
caattttgatacatacaccatc

SEQ ID NO: 244269 - DNA, 22 bp, Artificial sequence
  SiRNA target sequence
aattttgatacatacaccatca

SEQ ID NO: 244270 - DNA, 22 bp, Artificial sequence
  SiRNA target sequence
attttgatacatacaccatcat

SEQ ID NO: 244271 - DNA, 22 bp, Artificial sequence
  SiRNA target sequence
ttttgatacatacaccatcata

SEQ ID NO: 244272 - DNA, 22 bp, Artificial sequence
  SiRNA target sequence
tttgatacatacaccatcataa

SEQ ID NO: 244273 - DNA, 22 bp, Artificial sequence
  SiRNA target sequence
ttgatacatacaccatcataaa

SEQ ID NO: 244274 - DNA, 22 bp, Artificial sequence
  SiRNA target sequence
tgatacatacaccatcataaaa

SEQ ID NO: 244275 - DNA, 22 bp, Artificial sequence
  SiRNA target sequence
gatacatacaccatcataaaaa

SEQ ID NO: 244276 - DNA, 22 bp, Artificial sequence
  SiRNA target sequence
atacatacaccatcataaaaac

SEQ ID NO: 244277 - DNA, 22 bp, Artificial sequence
  SiRNA target sequence
tacatacaccatcataaaaact

SEQ ID NO: 244278 - DNA, 22 bp, Artificial sequence
  SiRNA target sequence
acatacaccatcataaaaactt

SEQ ID NO: 244279 - DNA, 22 bp, Artificial sequence
  SiRNA target sequence
catacaccatcataaaaacttt

SEQ ID NO: 244280 - DNA, 22 bp, Artificial sequence
  SiRNA target sequence
atacaccatcataaaaactttt

SEQ ID NO: 244281 - DNA, 22 bp, Artificial sequence
  SiRNA target sequence
tacaccatcataaaaactttta

SEQ ID NO: 244282 - DNA, 22 bp, Artificial sequence
  SiRNA target sequence
acaccatcataaaaacttttaa

SEQ ID NO: 244283 - DNA, 22 bp, Artificial sequence
  SiRNA target sequence
caccatcataaaaacttttaaa

SEQ ID NO: 244284 - DNA, 22 bp, Artificial sequence
  SiRNA target sequence
accatcataaaaacttttaaat

SEQ ID NO: 244285 - DNA, 22 bp, Artificial sequence
  SiRNA target sequence
ccatcataaaaacttttaaatt

SEQ ID NO: 244286 - DNA, 22 bp, Artificial sequence
  SiRNA target sequence
catcataaaaacttttaaattt

SEQ ID NO: 244287 - DNA, 22 bp, Artificial sequence
  SiRNA target sequence
atcataaaaacttttaaattta

SEQ ID NO: 244288 - DNA, 22 bp, Artificial sequence
  SiRNA target sequence
tcataaaaacttttaaatttat

SEQ ID NO: 244289 - DNA, 22 bp, Artificial sequence
  SiRNA target sequence
cataaaaacttttaaatttata

SEQ ID NO: 244290 - DNA, 22 bp, Artificial sequence
  SiRNA target sequence
ataaaaacttttaaatttatac

SEQ ID NO: 244291 - DNA, 22 bp, Artificial sequence
  SiRNA target sequence
taaaaacttttaaatttatacc

SEQ ID NO: 244292 - DNA, 22 bp, Artificial sequence
  SiRNA target sequence
aaaaacttttaaatttatacct

SEQ ID NO: 244293 - DNA, 22 bp, Artificial sequence
  SiRNA target sequence
aaaacttttaaatttatacctg

SEQ ID NO: 244294 - DNA, 22 bp, Artificial sequence
  SiRNA target sequence
aaacttttaaatttatacctgt

SEQ ID NO: 244295 - DNA, 22 bp, Artificial sequence
  SiRNA target sequence
aacttttaaatttatacctgta

SEQ ID NO: 244296 - DNA, 22 bp, Artificial sequence
  SiRNA target sequence
acttttaaatttatacctgtat

SEQ ID NO: 244297 - DNA, 22 bp, Artificial sequence
  SiRNA target sequence
cttttaaatttatacctgtatt

SEQ ID NO: 244298 - DNA, 22 bp, Artificial sequence
  SiRNA target sequence
ttttaaatttatacctgtattt

SEQ ID NO: 244299 - DNA, 22 bp, Artificial sequence
  SiRNA target sequence
tttaaatttatacctgtattta

SEQ ID NO: 244300 - DNA, 22 bp, Artificial sequence
  SiRNA target sequence
ttaaatttatacctgtatttaa

SEQ ID NO: 244301 - DNA, 22 bp, Artificial sequence
  SiRNA target sequence
taaatttatacctgtatttaac

SEQ ID NO: 244302 - DNA, 22 bp, Artificial sequence
  SiRNA target sequence
aaatttatacctgtatttaaca

SEQ ID NO: 244303 - DNA, 22 bp, Artificial sequence
  SiRNA target sequence
aatttatacctgtatttaacag

SEQ ID NO: 244304 - DNA, 22 bp, Artificial sequence
  SiRNA target sequence
atttatacctgtatttaacagg

SEQ ID NO: 244305 - DNA, 22 bp, Artificial sequence
  SiRNA target sequence
tttatacctgtatttaacaggc

SEQ ID NO: 244306 - DNA, 22 bp, Artificial sequence
  SiRNA target sequence
ttatacctgtatttaacaggca

SEQ ID NO: 244307 - DNA, 22 bp, Artificial sequence
  SiRNA target sequence
tatacctgtatttaacaggcac

SEQ ID NO: 244308 - DNA, 22 bp, Artificial sequence
  SiRNA target sequence
atacctgtatttaacaggcacc

SEQ ID NO: 244309 - DNA, 22 bp, Artificial sequence
  SiRNA target sequence
tacctgtatttaacaggcaccc

SEQ ID NO: 244310 - DNA, 22 bp, Artificial sequence
  SiRNA target sequence
acctgtatttaacaggcaccct

SEQ ID NO: 244311 - DNA, 22 bp, Artificial sequence
  SiRNA target sequence
cctgtatttaacaggcaccctc

SEQ ID NO: 244312 - DNA, 22 bp, Artificial sequence
  SiRNA target sequence
ctgtatttaacaggcaccctca

SEQ ID NO: 244313 - DNA, 22 bp, Artificial sequence
  SiRNA target sequence
tgtatttaacaggcaccctcat

SEQ ID NO: 244314 - DNA, 22 bp, Artificial sequence
  SiRNA target sequence
gtatttaacaggcaccctcata

SEQ ID NO: 244315 - DNA, 22 bp, Artificial sequence
  SiRNA target sequence
tatttaacaggcaccctcatag

SEQ ID NO: 244316 - DNA, 22 bp, Artificial sequence
  SiRNA target sequence
atttaacaggcaccctcataga

SEQ ID NO: 244317 - DNA, 22 bp, Artificial sequence
  SiRNA target sequence
tttaacaggcaccctcatagaa

SEQ ID NO: 244318 - DNA, 22 bp, Artificial sequence
  SiRNA target sequence
ttaacaggcaccctcatagaaa

SEQ ID NO: 244319 - DNA, 22 bp, Artificial sequence
  SiRNA target sequence
taacaggcaccctcatagaaag

SEQ ID NO: 244320 - DNA, 22 bp, Artificial sequence
  SiRNA target sequence
aacaggcaccctcatagaaagc

SEQ ID NO: 244321 - DNA, 22 bp, Artificial sequence
  SiRNA target sequence
acaggcaccctcatagaaagca

SEQ ID NO: 244322 - DNA, 22 bp, Artificial sequence
  SiRNA target sequence
caggcaccctcatagaaagcat

SEQ ID NO: 244323 - DNA, 22 bp, Artificial sequence
  SiRNA target sequence
aggcaccctcatagaaagcatt

SEQ ID NO: 244324 - DNA, 22 bp, Artificial sequence
  SiRNA target sequence
ggcaccctcatagaaagcattt

SEQ ID NO: 244325 - DNA, 22 bp, Artificial sequence
  SiRNA target sequence
gcaccctcatagaaagcatttc

SEQ ID NO: 244326 - DNA, 22 bp, Artificial sequence
  SiRNA target sequence
caccctcatagaaagcatttct

SEQ ID NO: 244327 - DNA, 22 bp, Artificial sequence
  SiRNA target sequence
accctcatagaaagcatttctt

SEQ ID NO: 244328 - DNA, 22 bp, Artificial sequence
  SiRNA target sequence
ccctcatagaaagcatttcttt

SEQ ID NO: 244329 - DNA, 22 bp, Artificial sequence
  SiRNA target sequence
cctcatagaaagcatttctttt

SEQ ID NO: 244330 - DNA, 22 bp, Artificial sequence
  SiRNA target sequence
ctcatagaaagcatttcttttg

SEQ ID NO: 244331 - DNA, 22 bp, Artificial sequence
  SiRNA target sequence
tcatagaaagcatttcttttgc

SEQ ID NO: 244332 - DNA, 22 bp, Artificial sequence
  SiRNA target sequence
catagaaagcatttcttttgct

SEQ ID NO: 244333 - DNA, 22 bp, Artificial sequence
  SiRNA target sequence
atagaaagcatttcttttgcta

SEQ ID NO: 244334 - DNA, 22 bp, Artificial sequence
  SiRNA target sequence
tagaaagcatttcttttgctaa

SEQ ID NO: 244335 - DNA, 22 bp, Artificial sequence
  SiRNA target sequence
agaaagcatttcttttgctaaa

SEQ ID NO: 244336 - DNA, 22 bp, Artificial sequence
  SiRNA target sequence
gaaagcatttcttttgctaaat

SEQ ID NO: 244337 - DNA, 22 bp, Artificial sequence
  SiRNA target sequence
aaagcatttcttttgctaaatc

SEQ ID NO: 244338 - DNA, 22 bp, Artificial sequence
  SiRNA target sequence
aagcatttcttttgctaaatca

SEQ ID NO: 244339 - DNA, 22 bp, Artificial sequence
  SiRNA target sequence
agcatttcttttgctaaatcaa

SEQ ID NO: 244340 - DNA, 22 bp, Artificial sequence
  SiRNA target sequence
gcatttcttttgctaaatcaaa

SEQ ID NO: 244341 - DNA, 22 bp, Artificial sequence
  SiRNA target sequence
catttcttttgctaaatcaaat

SEQ ID NO: 244342 - DNA, 22 bp, Artificial sequence
  SiRNA target sequence
atttcttttgctaaatcaaata

SEQ ID NO: 244343 - DNA, 22 bp, Artificial sequence
  SiRNA target sequence
tttcttttgctaaatcaaataa

SEQ ID NO: 244344 - DNA, 22 bp, Artificial sequence
  SiRNA target sequence
ttcttttgctaaatcaaataaa

SEQ ID NO: 244345 - DNA, 22 bp, Artificial sequence
  SiRNA target sequence
tcttttgctaaatcaaataaaa

SEQ ID NO: 244346 - DNA, 22 bp, Artificial sequence
  SiRNA target sequence
cttttgctaaatcaaataaaac

SEQ ID NO: 244347 - DNA, 22 bp, Artificial sequence
  SiRNA target sequence
ttttgctaaatcaaataaaaca

SEQ ID NO: 244348 - DNA, 22 bp, Artificial sequence
  SiRNA target sequence
tttgctaaatcaaataaaacat

SEQ ID NO: 244349 - DNA, 22 bp, Artificial sequence
  SiRNA target sequence
ttgctaaatcaaataaaacata

SEQ ID NO: 244350 - DNA, 22 bp, Artificial sequence
  SiRNA target sequence
tgctaaatcaaataaaacatat

SEQ ID NO: 244351 - DNA, 22 bp, Artificial sequence
  SiRNA target sequence
gctaaatcaaataaaacatatt

SEQ ID NO: 244352 - DNA, 22 bp, Artificial sequence
  SiRNA target sequence
ctaaatcaaataaaacatattt

SEQ ID NO: 244353 - DNA, 22 bp, Artificial sequence
  SiRNA target sequence
taaatcaaataaaacatatttg

SEQ ID NO: 244354 - DNA, 22 bp, Artificial sequence
  SiRNA target sequence
aaatcaaataaaacatatttgg

SEQ ID NO: 244355 - DNA, 22 bp, Artificial sequence
  SiRNA target sequence
aatcaaataaaacatatttggt

SEQ ID NO: 244356 - DNA, 22 bp, Artificial sequence
  SiRNA target sequence
atcaaataaaacatatttggta

SEQ ID NO: 244357 - DNA, 22 bp, Artificial sequence
  SiRNA target sequence
tcaaataaaacatatttggtaa

SEQ ID NO: 244358 - DNA, 22 bp, Artificial sequence
  SiRNA target sequence
caaataaaacatatttggtaat

SEQ ID NO: 244359 - DNA, 22 bp, Artificial sequence
  SiRNA target sequence
aaataaaacatatttggtaatt

SEQ ID NO: 244360 - DNA, 22 bp, Artificial sequence
  SiRNA target sequence
aataaaacatatttggtaattt

SEQ ID NO: 244361 - DNA, 22 bp, Artificial sequence
  SiRNA target sequence
ataaaacatatttggtaatttt

SEQ ID NO: 244362 - DNA, 22 bp, Artificial sequence
  SiRNA target sequence
taaaacatatttggtaatttta

SEQ ID NO: 244363 - DNA, 22 bp, Artificial sequence
  SiRNA target sequence
aaaacatatttggtaattttag

SEQ ID NO: 244364 - DNA, 22 bp, Artificial sequence
  SiRNA target sequence
aaacatatttggtaattttaga

SEQ ID NO: 244365 - DNA, 22 bp, Artificial sequence
  SiRNA target sequence
aacatatttggtaattttagaa

SEQ ID NO: 244366 - DNA, 22 bp, Artificial sequence
  SiRNA target sequence
acatatttggtaattttagaaa

SEQ ID NO: 244367 - DNA, 22 bp, Artificial sequence
  SiRNA target sequence
catatttggtaattttagaaaa

SEQ ID NO: 244368 - DNA, 22 bp, Artificial sequence
  SiRNA target sequence
atatttggtaattttagaaaat

SEQ ID NO: 244369 - DNA, 22 bp, Artificial sequence
  SiRNA target sequence
tatttggtaattttagaaaatg

SEQ ID NO: 244370 - DNA, 22 bp, Artificial sequence
  SiRNA target sequence
atttggtaattttagaaaatgc

SEQ ID NO: 244371 - DNA, 22 bp, Artificial sequence
  SiRNA target sequence
tttggtaattttagaaaatgca

SEQ ID NO: 244372 - DNA, 22 bp, Artificial sequence
  SiRNA target sequence
ttggtaattttagaaaatgcaa

SEQ ID NO: 244373 - DNA, 22 bp, Artificial sequence
  SiRNA target sequence
tggtaattttagaaaatgcaaa

SEQ ID NO: 244374 - DNA, 22 bp, Artificial sequence
  SiRNA target sequence
ggtaattttagaaaatgcaaat

SEQ ID NO: 244375 - DNA, 22 bp, Artificial sequence
  SiRNA target sequence
gtaattttagaaaatgcaaatc

SEQ ID NO: 244376 - DNA, 22 bp, Artificial sequence
  SiRNA target sequence
taattttagaaaatgcaaatcc

SEQ ID NO: 244377 - DNA, 22 bp, Artificial sequence
  SiRNA target sequence
aattttagaaaatgcaaatcca

SEQ ID NO: 244378 - DNA, 22 bp, Artificial sequence
  SiRNA target sequence
attttagaaaatgcaaatccaa

SEQ ID NO: 244379 - DNA, 22 bp, Artificial sequence
  SiRNA target sequence
ttttagaaaatgcaaatccaat

SEQ ID NO: 244380 - DNA, 22 bp, Artificial sequence
  SiRNA target sequence
tttagaaaatgcaaatccaatg

SEQ ID NO: 244381 - DNA, 22 bp, Artificial sequence
  SiRNA target sequence
ttagaaaatgcaaatccaatgg

SEQ ID NO: 244382 - DNA, 22 bp, Artificial sequence
  SiRNA target sequence
tagaaaatgcaaatccaatggt

SEQ ID NO: 244383 - DNA, 22 bp, Artificial sequence
  SiRNA target sequence
agaaaatgcaaatccaatggtt

SEQ ID NO: 244384 - DNA, 22 bp, Artificial sequence
  SiRNA target sequence
gaaaatgcaaatccaatggttg

SEQ ID NO: 244385 - DNA, 22 bp, Artificial sequence
  SiRNA target sequence
aaaatgcaaatccaatggttgc

SEQ ID NO: 244386 - DNA, 22 bp, Artificial sequence
  SiRNA target sequence
aaatgcaaatccaatggttgca

SEQ ID NO: 244387 - DNA, 22 bp, Artificial sequence
  SiRNA target sequence
aatgcaaatccaatggttgcac

SEQ ID NO: 244388 - DNA, 22 bp, Artificial sequence
  SiRNA target sequence
atgcaaatccaatggttgcaca

SEQ ID NO: 244389 - DNA, 22 bp, Artificial sequence
  SiRNA target sequence
tgcaaatccaatggttgcacac

SEQ ID NO: 244390 - DNA, 22 bp, Artificial sequence
  SiRNA target sequence
gcaaatccaatggttgcacacc

SEQ ID NO: 244391 - DNA, 22 bp, Artificial sequence
  SiRNA target sequence
caaatccaatggttgcacacca

SEQ ID NO: 244392 - DNA, 22 bp, Artificial sequence
  SiRNA target sequence
aaatccaatggttgcacaccaa

SEQ ID NO: 244393 - DNA, 22 bp, Artificial sequence
  SiRNA target sequence
aatccaatggttgcacaccaat

SEQ ID NO: 244394 - DNA, 22 bp, Artificial sequence
  SiRNA target sequence
atccaatggttgcacaccaatt

SEQ ID NO: 244395 - DNA, 22 bp, Artificial sequence
  SiRNA target sequence
tccaatggttgcacaccaattt

SEQ ID NO: 244396 - DNA, 22 bp, Artificial sequence
  SiRNA target sequence
ccaatggttgcacaccaatttt

SEQ ID NO: 244397 - DNA, 22 bp, Artificial sequence
  SiRNA target sequence
caatggttgcacaccaattttc

SEQ ID NO: 244398 - DNA, 22 bp, Artificial sequence
  SiRNA target sequence
aatggttgcacaccaattttca

SEQ ID NO: 244399 - DNA, 22 bp, Artificial sequence
  SiRNA target sequence
atggttgcacaccaattttcaa

SEQ ID NO: 244400 - DNA, 22 bp, Artificial sequence
  SiRNA target sequence
tggttgcacaccaattttcaag

SEQ ID NO: 244401 - DNA, 22 bp, Artificial sequence
  SiRNA target sequence
ggttgcacaccaattttcaaga

SEQ ID NO: 244402 - DNA, 22 bp, Artificial sequence
  SiRNA target sequence
gttgcacaccaattttcaagat

SEQ ID NO: 244403 - DNA, 22 bp, Artificial sequence
  SiRNA target sequence
ttgcacaccaattttcaagatt

SEQ ID NO: 244404 - DNA, 22 bp, Artificial sequence
  SiRNA target sequence
tgcacaccaattttcaagattt

SEQ ID NO: 244405 - DNA, 22 bp, Artificial sequence
  SiRNA target sequence
gcacaccaattttcaagattta

SEQ ID NO: 244406 - DNA, 22 bp, Artificial sequence
  SiRNA target sequence
cacaccaattttcaagatttat

SEQ ID NO: 244407 - DNA, 22 bp, Artificial sequence
  SiRNA target sequence
acaccaattttcaagatttatt

SEQ ID NO: 244408 - DNA, 22 bp, Artificial sequence
  SiRNA target sequence
caccaattttcaagatttattc

SEQ ID NO: 244409 - DNA, 22 bp, Artificial sequence
  SiRNA target sequence
accaattttcaagatttattct

SEQ ID NO: 244410 - DNA, 22 bp, Artificial sequence
  SiRNA target sequence
ccaattttcaagatttattctt

SEQ ID NO: 244411 - DNA, 22 bp, Artificial sequence
  SiRNA target sequence
caattttcaagatttattctta

SEQ ID NO: 244412 - DNA, 22 bp, Artificial sequence
  SiRNA target sequence
aattttcaagatttattcttaa

SEQ ID NO: 244413 - DNA, 22 bp, Artificial sequence
  SiRNA target sequence
attttcaagatttattcttaag

SEQ ID NO: 244414 - DNA, 22 bp, Artificial sequence
  SiRNA target sequence
ttttcaagatttattcttaaga

SEQ ID NO: 244415 - DNA, 22 bp, Artificial sequence
  SiRNA target sequence
tttcaagatttattcttaagac

SEQ ID NO: 244416 - DNA, 22 bp, Artificial sequence
  SiRNA target sequence
ttcaagatttattcttaagacc

SEQ ID NO: 244417 - DNA, 22 bp, Artificial sequence
  SiRNA target sequence
tcaagatttattcttaagaccg

SEQ ID NO: 244418 - DNA, 22 bp, Artificial sequence
  SiRNA target sequence
caagatttattcttaagaccga

SEQ ID NO: 244419 - DNA, 22 bp, Artificial sequence
  SiRNA target sequence
aagatttattcttaagaccgat

SEQ ID NO: 244420 - DNA, 22 bp, Artificial sequence
  SiRNA target sequence
agatttattcttaagaccgatg

SEQ ID NO: 244421 - DNA, 22 bp, Artificial sequence
  SiRNA target sequence
gatttattcttaagaccgatgg

SEQ ID NO: 244422 - DNA, 22 bp, Artificial sequence
  SiRNA target sequence
atttattcttaagaccgatgga

SEQ ID NO: 244423 - DNA, 22 bp, Artificial sequence
  SiRNA target sequence
tttattcttaagaccgatggag

SEQ ID NO: 244424 - DNA, 22 bp, Artificial sequence
  SiRNA target sequence
ttattcttaagaccgatggagc

SEQ ID NO: 244425 - DNA, 22 bp, Artificial sequence
  SiRNA target sequence
tattcttaagaccgatggagct

SEQ ID NO: 244426 - DNA, 22 bp, Artificial sequence
  SiRNA target sequence
attcttaagaccgatggagctg

SEQ ID NO: 244427 - DNA, 22 bp, Artificial sequence
  SiRNA target sequence
ttcttaagaccgatggagctgt

SEQ ID NO: 244428 - DNA, 22 bp, Artificial sequence
  SiRNA target sequence
tcttaagaccgatggagctgtg

SEQ ID NO: 244429 - DNA, 22 bp, Artificial sequence
  SiRNA target sequence
cttaagaccgatggagctgtgc

SEQ ID NO: 244430 - DNA, 22 bp, Artificial sequence
  SiRNA target sequence
ttaagaccgatggagctgtgcg

SEQ ID NO: 244431 - DNA, 22 bp, Artificial sequence
  SiRNA target sequence
taagaccgatggagctgtgcgc

SEQ ID NO: 244432 - DNA, 22 bp, Artificial sequence
  SiRNA target sequence
aagaccgatggagctgtgcgca

SEQ ID NO: 244433 - DNA, 22 bp, Artificial sequence
  SiRNA target sequence
agaccgatggagctgtgcgcaa

SEQ ID NO: 244434 - DNA, 22 bp, Artificial sequence
  SiRNA target sequence
gaccgatggagctgtgcgcaaa

SEQ ID NO: 244435 - DNA, 22 bp, Artificial sequence
  SiRNA target sequence
accgatggagctgtgcgcaaat

SEQ ID NO: 244436 - DNA, 22 bp, Artificial sequence
  SiRNA target sequence
ccgatggagctgtgcgcaaatt

SEQ ID NO: 244437 - DNA, 22 bp, Artificial sequence
  SiRNA target sequence
cgatggagctgtgcgcaaattg

SEQ ID NO: 244438 - DNA, 22 bp, Artificial sequence
  SiRNA target sequence
gatggagctgtgcgcaaattgt

SEQ ID NO: 244439 - DNA, 22 bp, Artificial sequence
  SiRNA target sequence
atggagctgtgcgcaaattgta

SEQ ID NO: 244440 - DNA, 22 bp, Artificial sequence
  SiRNA target sequence
tggagctgtgcgcaaattgtaa

SEQ ID NO: 244441 - DNA, 22 bp, Artificial sequence
  SiRNA target sequence
ggagctgtgcgcaaattgtaaa

SEQ ID NO: 244442 - DNA, 22 bp, Artificial sequence
  SiRNA target sequence
gagctgtgcgcaaattgtaaaa

SEQ ID NO: 244443 - DNA, 22 bp, Artificial sequence
  SiRNA target sequence
agctgtgcgcaaattgtaaaaa

SEQ ID NO: 244444 - DNA, 22 bp, Artificial sequence
  SiRNA target sequence
gctgtgcgcaaattgtaaaaag

SEQ ID NO: 244445 - DNA, 22 bp, Artificial sequence
  SiRNA target sequence
ctgtgcgcaaattgtaaaaaga

SEQ ID NO: 244446 - DNA, 22 bp, Artificial sequence
  SiRNA target sequence
tgtgcgcaaattgtaaaaagaa

SEQ ID NO: 244447 - DNA, 22 bp, Artificial sequence
  SiRNA target sequence
gtgcgcaaattgtaaaaagaaa

SEQ ID NO: 244448 - DNA, 22 bp, Artificial sequence
  SiRNA target sequence
tgcgcaaattgtaaaaagaaag

SEQ ID NO: 244449 - DNA, 22 bp, Artificial sequence
  SiRNA target sequence
gcgcaaattgtaaaaagaaagt

SEQ ID NO: 244450 - DNA, 22 bp, Artificial sequence
  SiRNA target sequence
cgcaaattgtaaaaagaaagtc

SEQ ID NO: 244451 - DNA, 22 bp, Artificial sequence
  SiRNA target sequence
gcaaattgtaaaaagaaagtcc

SEQ ID NO: 244452 - DNA, 22 bp, Artificial sequence
  SiRNA target sequence
caaattgtaaaaagaaagtcct

SEQ ID NO: 244453 - DNA, 22 bp, Artificial sequence
  SiRNA target sequence
aaattgtaaaaagaaagtcctg

SEQ ID NO: 244454 - DNA, 22 bp, Artificial sequence
  SiRNA target sequence
aattgtaaaaagaaagtcctga

SEQ ID NO: 244455 - DNA, 22 bp, Artificial sequence
  SiRNA target sequence
attgtaaaaagaaagtcctgaa

SEQ ID NO: 244456 - DNA, 22 bp, Artificial sequence
  SiRNA target sequence
ttgtaaaaagaaagtcctgaaa

SEQ ID NO: 244457 - DNA, 22 bp, Artificial sequence
  SiRNA target sequence
tgtaaaaagaaagtcctgaaat

SEQ ID NO: 244458 - DNA, 22 bp, Artificial sequence
  SiRNA target sequence
gtaaaaagaaagtcctgaaatt

SEQ ID NO: 244459 - DNA, 22 bp, Artificial sequence
  SiRNA target sequence
taaaaagaaagtcctgaaatta

SEQ ID NO: 244460 - DNA, 22 bp, Artificial sequence
  SiRNA target sequence
aaaaagaaagtcctgaaattag

SEQ ID NO: 244461 - DNA, 22 bp, Artificial sequence
  SiRNA target sequence
aaaagaaagtcctgaaattaga

SEQ ID NO: 244462 - DNA, 22 bp, Artificial sequence
  SiRNA target sequence
aaagaaagtcctgaaattagag

SEQ ID NO: 244463 - DNA, 22 bp, Artificial sequence
  SiRNA target sequence
aagaaagtcctgaaattagagc

SEQ ID NO: 244464 - DNA, 22 bp, Artificial sequence
  SiRNA target sequence
agaaagtcctgaaattagagcg

SEQ ID NO: 244465 - DNA, 22 bp, Artificial sequence
  SiRNA target sequence
gaaagtcctgaaattagagcgg

SEQ ID NO: 244466 - DNA, 22 bp, Artificial sequence
  SiRNA target sequence
aaagtcctgaaattagagcggt

SEQ ID NO: 244467 - DNA, 22 bp, Artificial sequence
  SiRNA target sequence
aagtcctgaaattagagcggta

SEQ ID NO: 244468 - DNA, 22 bp, Artificial sequence
  SiRNA target sequence
agtcctgaaattagagcggtaa

SEQ ID NO: 244469 - DNA, 22 bp, Artificial sequence
  SiRNA target sequence
gtcctgaaattagagcggtaaa

SEQ ID NO: 244470 - DNA, 22 bp, Artificial sequence
  SiRNA target sequence
tcctgaaattagagcggtaaaa

SEQ ID NO: 244471 - DNA, 22 bp, Artificial sequence
  SiRNA target sequence
cctgaaattagagcggtaaaaa

SEQ ID NO: 244472 - DNA, 22 bp, Artificial sequence
  SiRNA target sequence
ctgaaattagagcggtaaaaaa

SEQ ID NO: 244473 - DNA, 22 bp, Artificial sequence
  SiRNA target sequence
tgaaattagagcggtaaaaaat

SEQ ID NO: 244474 - DNA, 22 bp, Artificial sequence
  SiRNA target sequence
gaaattagagcggtaaaaaata

SEQ ID NO: 244475 - DNA, 22 bp, Artificial sequence
  SiRNA target sequence
aaattagagcggtaaaaaatat

SEQ ID NO: 244476 - DNA, 22 bp, Artificial sequence
  SiRNA target sequence
aattagagcggtaaaaaatata

SEQ ID NO: 244477 - DNA, 22 bp, Artificial sequence
  SiRNA target sequence
attagagcggtaaaaaatatag

SEQ ID NO: 244478 - DNA, 22 bp, Artificial sequence
  SiRNA target sequence
ttagagcggtaaaaaatatagc

SEQ ID NO: 244479 - DNA, 22 bp, Artificial sequence
  SiRNA target sequence
tagagcggtaaaaaatatagca

SEQ ID NO: 244480 - DNA, 22 bp, Artificial sequence
  SiRNA target sequence
agagcggtaaaaaatatagcag

SEQ ID NO: 244481 - DNA, 22 bp, Artificial sequence
  SiRNA target sequence
gagcggtaaaaaatatagcagc

SEQ ID NO: 244482 - DNA, 22 bp, Artificial sequence
  SiRNA target sequence
agcggtaaaaaatatagcagca

SEQ ID NO: 244483 - DNA, 22 bp, Artificial sequence
  SiRNA target sequence
gcggtaaaaaatatagcagcaa

SEQ ID NO: 244484 - DNA, 22 bp, Artificial sequence
  SiRNA target sequence
cggtaaaaaatatagcagcaat

SEQ ID NO: 244485 - DNA, 22 bp, Artificial sequence
  SiRNA target sequence
ggtaaaaaatatagcagcaata

SEQ ID NO: 244486 - DNA, 22 bp, Artificial sequence
  SiRNA target sequence
gtaaaaaatatagcagcaatag

SEQ ID NO: 244487 - DNA, 22 bp, Artificial sequence
  SiRNA target sequence
taaaaaatatagcagcaatagg

SEQ ID NO: 244488 - DNA, 22 bp, Artificial sequence
  SiRNA target sequence
aaaaaatatagcagcaataggg

SEQ ID NO: 244489 - DNA, 22 bp, Artificial sequence
  SiRNA target sequence
aaaaatatagcagcaatagggg

SEQ ID NO: 244490 - DNA, 22 bp, Artificial sequence
  SiRNA target sequence
aaaatatagcagcaatagggga

SEQ ID NO: 244491 - DNA, 22 bp, Artificial sequence
  SiRNA target sequence
aaatatagcagcaataggggag

SEQ ID NO: 244492 - DNA, 22 bp, Artificial sequence
  SiRNA target sequence
aatatagcagcaataggggagg

SEQ ID NO: 244493 - DNA, 22 bp, Artificial sequence
  SiRNA target sequence
atatagcagcaataggggaggc

SEQ ID NO: 244494 - DNA, 22 bp, Artificial sequence
  SiRNA target sequence
tatagcagcaataggggaggca

SEQ ID NO: 244495 - DNA, 22 bp, Artificial sequence
  SiRNA target sequence
atagcagcaataggggaggcaa

SEQ ID NO: 244496 - DNA, 22 bp, Artificial sequence
  SiRNA target sequence
tagcagcaataggggaggcaat

SEQ ID NO: 244497 - DNA, 22 bp, Artificial sequence
  SiRNA target sequence
agcagcaataggggaggcaata

SEQ ID NO: 244498 - DNA, 22 bp, Artificial sequence
  SiRNA target sequence
gcagcaataggggaggcaatag

SEQ ID NO: 244499 - DNA, 22 bp, Artificial sequence
  SiRNA target sequence
cagcaataggggaggcaataga

SEQ ID NO: 244500 - DNA, 22 bp, Artificial sequence
  SiRNA target sequence
agcaataggggaggcaatagat

SEQ ID NO: 244501 - DNA, 22 bp, Artificial sequence
  SiRNA target sequence
gcaataggggaggcaatagata

SEQ ID NO: 244502 - DNA, 22 bp, Artificial sequence
  SiRNA target sequence
caataggggaggcaatagatag

SEQ ID NO: 244503 - DNA, 22 bp, Artificial sequence
  SiRNA target sequence
aataggggaggcaatagataga

SEQ ID NO: 244504 - DNA, 22 bp, Artificial sequence
  SiRNA target sequence
ataggggaggcaatagatagat

SEQ ID NO: 244505 - DNA, 22 bp, Artificial sequence
  SiRNA target sequence
taggggaggcaatagatagata

SEQ ID NO: 244506 - DNA, 22 bp, Artificial sequence
  SiRNA target sequence
aggggaggcaatagatagataa

SEQ ID NO: 244507 - DNA, 22 bp, Artificial sequence
  SiRNA target sequence
ggggaggcaatagatagataaa

SEQ ID NO: 244508 - DNA, 22 bp, Artificial sequence
  SiRNA target sequence
gggaggcaatagatagataaaa

SEQ ID NO: 244509 - DNA, 22 bp, Artificial sequence
  SiRNA target sequence
ggaggcaatagatagataaaag

SEQ ID NO: 244510 - DNA, 22 bp, Artificial sequence
  SiRNA target sequence
gaggcaatagatagataaaaga

SEQ ID NO: 244511 - DNA, 22 bp, Artificial sequence
  SiRNA target sequence
aggcaatagatagataaaagat

SEQ ID NO: 244512 - DNA, 22 bp, Artificial sequence
  SiRNA target sequence
ggcaatagatagataaaagatc

SEQ ID NO: 244513 - DNA, 22 bp, Artificial sequence
  SiRNA target sequence
gcaatagatagataaaagatcc

SEQ ID NO: 244514 - DNA, 22 bp, Artificial sequence
  SiRNA target sequence
caatagatagataaaagatcct

SEQ ID NO: 244515 - DNA, 22 bp, Artificial sequence
  SiRNA target sequence
aatagatagataaaagatcctt

SEQ ID NO: 244516 - DNA, 22 bp, Artificial sequence
  SiRNA target sequence
atagatagataaaagatccttg

SEQ ID NO: 244517 - DNA, 22 bp, Artificial sequence
  SiRNA target sequence
tagatagataaaagatccttga

SEQ ID NO: 244518 - DNA, 22 bp, Artificial sequence
  SiRNA target sequence
agatagataaaagatccttgat

SEQ ID NO: 244519 - DNA, 22 bp, Artificial sequence
  SiRNA target sequence
gatagataaaagatccttgatg

SEQ ID NO: 244520 - DNA, 22 bp, Artificial sequence
  SiRNA target sequence
atagataaaagatccttgatgc

SEQ ID NO: 244521 - DNA, 22 bp, Artificial sequence
  SiRNA target sequence
tagataaaagatccttgatgca

SEQ ID NO: 244522 - DNA, 22 bp, Artificial sequence
  SiRNA target sequence
agataaaagatccttgatgcaa

SEQ ID NO: 244523 - DNA, 22 bp, Artificial sequence
  SiRNA target sequence
gataaaagatccttgatgcaat

SEQ ID NO: 244524 - DNA, 22 bp, Artificial sequence
  SiRNA target sequence
ataaaagatccttgatgcaatg

SEQ ID NO: 244525 - DNA, 22 bp, Artificial sequence
  SiRNA target sequence
taaaagatccttgatgcaatgc

SEQ ID NO: 244526 - DNA, 22 bp, Artificial sequence
  SiRNA target sequence
aaaagatccttgatgcaatgcg

SEQ ID NO: 244527 - DNA, 22 bp, Artificial sequence
  SiRNA target sequence
aaagatccttgatgcaatgcga

SEQ ID NO: 244528 - DNA, 22 bp, Artificial sequence
  SiRNA target sequence
aagatccttgatgcaatgcgat

SEQ ID NO: 244529 - DNA, 22 bp, Artificial sequence
  SiRNA target sequence
agatccttgatgcaatgcgatt

SEQ ID NO: 244530 - DNA, 22 bp, Artificial sequence
  SiRNA target sequence
gatccttgatgcaatgcgattt

SEQ ID NO: 244531 - DNA, 22 bp, Artificial sequence
  SiRNA target sequence
atccttgatgcaatgcgatttc

SEQ ID NO: 244532 - DNA, 22 bp, Artificial sequence
  SiRNA target sequence
tccttgatgcaatgcgatttcc

SEQ ID NO: 244533 - DNA, 22 bp, Artificial sequence
  SiRNA target sequence
ccttgatgcaatgcgatttcca

SEQ ID NO: 244534 - DNA, 22 bp, Artificial sequence
  SiRNA target sequence
cttgatgcaatgcgatttccac

SEQ ID NO: 244535 - DNA, 22 bp, Artificial sequence
  SiRNA target sequence
ttgatgcaatgcgatttccacg

SEQ ID NO: 244536 - DNA, 22 bp, Artificial sequence
  SiRNA target sequence
tgatgcaatgcgatttccacgg

SEQ ID NO: 244537 - DNA, 22 bp, Artificial sequence
  SiRNA target sequence
gatgcaatgcgatttccacgga

SEQ ID NO: 244538 - DNA, 22 bp, Artificial sequence
  SiRNA target sequence
atgcaatgcgatttccacggat

SEQ ID NO: 244539 - DNA, 22 bp, Artificial sequence
  SiRNA target sequence
tgcaatgcgatttccacggatt

SEQ ID NO: 244540 - DNA, 22 bp, Artificial sequence
  SiRNA target sequence
gcaatgcgatttccacggatta

SEQ ID NO: 244541 - DNA, 22 bp, Artificial sequence
  SiRNA target sequence
caatgcgatttccacggattac

SEQ ID NO: 244542 - DNA, 22 bp, Artificial sequence
  SiRNA target sequence
aatgcgatttccacggattaca

SEQ ID NO: 244543 - DNA, 22 bp, Artificial sequence
  SiRNA target sequence
atgcgatttccacggattacaa

SEQ ID NO: 244544 - DNA, 22 bp, Artificial sequence
  SiRNA target sequence
tgcgatttccacggattacaaa

SEQ ID NO: 244545 - DNA, 22 bp, Artificial sequence
  SiRNA target sequence
gcgatttccacggattacaaag

SEQ ID NO: 244546 - DNA, 22 bp, Artificial sequence
  SiRNA target sequence
cgatttccacggattacaaagt

SEQ ID NO: 244547 - DNA, 22 bp, Artificial sequence
  SiRNA target sequence
gatttccacggattacaaagtt

SEQ ID NO: 244548 - DNA, 22 bp, Artificial sequence
  SiRNA target sequence
atttccacggattacaaagtta

SEQ ID NO: 244549 - DNA, 22 bp, Artificial sequence
  SiRNA target sequence
tttccacggattacaaagttat

SEQ ID NO: 244550 - DNA, 22 bp, Artificial sequence
  SiRNA target sequence
ttccacggattacaaagttata

SEQ ID NO: 244551 - DNA, 22 bp, Artificial sequence
  SiRNA target sequence
tccacggattacaaagttataa

SEQ ID NO: 244552 - DNA, 22 bp, Artificial sequence
  SiRNA target sequence
ccacggattacaaagttataaa

SEQ ID NO: 244553 - DNA, 22 bp, Artificial sequence
  SiRNA target sequence
cacggattacaaagttataaaa

SEQ ID NO: 244554 - DNA, 22 bp, Artificial sequence
  SiRNA target sequence
acggattacaaagttataaaat

SEQ ID NO: 244555 - DNA, 22 bp, Artificial sequence
  SiRNA target sequence
cggattacaaagttataaaata

SEQ ID NO: 244556 - DNA, 22 bp, Artificial sequence
  SiRNA target sequence
ggattacaaagttataaaataa

SEQ ID NO: 244557 - DNA, 22 bp, Artificial sequence
  SiRNA target sequence
gattacaaagttataaaataat

SEQ ID NO: 244558 - DNA, 22 bp, Artificial sequence
  SiRNA target sequence
attacaaagttataaaataatg

SEQ ID NO: 244559 - DNA, 22 bp, Artificial sequence
  SiRNA target sequence
ttacaaagttataaaataatga

SEQ ID NO: 244560 - DNA, 22 bp, Artificial sequence
  SiRNA target sequence
tacaaagttataaaataatgat

SEQ ID NO: 244561 - DNA, 22 bp, Artificial sequence
  SiRNA target sequence
acaaagttataaaataatgata

SEQ ID NO: 244562 - DNA, 22 bp, Artificial sequence
  SiRNA target sequence
caaagttataaaataatgatac

SEQ ID NO: 244563 - DNA, 22 bp, Artificial sequence
  SiRNA target sequence
aaagttataaaataatgataca

SEQ ID NO: 244564 - DNA, 22 bp, Artificial sequence
  SiRNA target sequence
aagttataaaataatgatacag

SEQ ID NO: 244565 - DNA, 22 bp, Artificial sequence
  SiRNA target sequence
agttataaaataatgatacagc

SEQ ID NO: 244566 - DNA, 22 bp, Artificial sequence
  SiRNA target sequence
gttataaaataatgatacagca

SEQ ID NO: 244567 - DNA, 22 bp, Artificial sequence
  SiRNA target sequence
ttataaaataatgatacagcac

SEQ ID NO: 244568 - DNA, 22 bp, Artificial sequence
  SiRNA target sequence
tataaaataatgatacagcact

SEQ ID NO: 244569 - DNA, 22 bp, Artificial sequence
  SiRNA target sequence
ataaaataatgatacagcacta

SEQ ID NO: 244570 - DNA, 22 bp, Artificial sequence
  SiRNA target sequence
taaaataatgatacagcactaa

SEQ ID NO: 244571 - DNA, 22 bp, Artificial sequence
  SiRNA target sequence
aaaataatgatacagcactaat

SEQ ID NO: 244572 - DNA, 22 bp, Artificial sequence
  SiRNA target sequence
aaataatgatacagcactaatc

SEQ ID NO: 244573 - DNA, 22 bp, Artificial sequence
  SiRNA target sequence
aataatgatacagcactaatcg

SEQ ID NO: 244574 - DNA, 22 bp, Artificial sequence
  SiRNA target sequence
ataatgatacagcactaatcgt

SEQ ID NO: 244575 - DNA, 22 bp, Artificial sequence
  SiRNA target sequence
taatgatacagcactaatcgtt

SEQ ID NO: 244576 - DNA, 22 bp, Artificial sequence
  SiRNA target sequence
aatgatacagcactaatcgtta

SEQ ID NO: 244577 - DNA, 22 bp, Artificial sequence
  SiRNA target sequence
atgatacagcactaatcgttaa

SEQ ID NO: 244578 - DNA, 22 bp, Artificial sequence
  SiRNA target sequence
tgatacagcactaatcgttaag

SEQ ID NO: 244579 - DNA, 22 bp, Artificial sequence
  SiRNA target sequence
gatacagcactaatcgttaagg

SEQ ID NO: 244580 - DNA, 22 bp, Artificial sequence
  SiRNA target sequence
atacagcactaatcgttaagga

SEQ ID NO: 244581 - DNA, 22 bp, Artificial sequence
  SiRNA target sequence
tacagcactaatcgttaaggaa

SEQ ID NO: 244582 - DNA, 22 bp, Artificial sequence
  SiRNA target sequence
acagcactaatcgttaaggaag

SEQ ID NO: 244583 - DNA, 22 bp, Artificial sequence
  SiRNA target sequence
cagcactaatcgttaaggaagt

SEQ ID NO: 244584 - DNA, 22 bp, Artificial sequence
  SiRNA target sequence
agcactaatcgttaaggaagtt

SEQ ID NO: 244585 - DNA, 22 bp, Artificial sequence
  SiRNA target sequence
gcactaatcgttaaggaagttg

SEQ ID NO: 244586 - DNA, 22 bp, Artificial sequence
  SiRNA target sequence
cactaatcgttaaggaagttgt

SEQ ID NO: 244587 - DNA, 22 bp, Artificial sequence
  SiRNA target sequence
actaatcgttaaggaagttgtt

SEQ ID NO: 244588 - DNA, 22 bp, Artificial sequence
  SiRNA target sequence
ctaatcgttaaggaagttgtta

SEQ ID NO: 244589 - DNA, 22 bp, Artificial sequence
  SiRNA target sequence
taatcgttaaggaagttgttac

SEQ ID NO: 244590 - DNA, 22 bp, Artificial sequence
  SiRNA target sequence
aatcgttaaggaagttgttact

SEQ ID NO: 244591 - DNA, 22 bp, Artificial sequence
  SiRNA target sequence
atcgttaaggaagttgttacta

SEQ ID NO: 244592 - DNA, 22 bp, Artificial sequence
  SiRNA target sequence
tcgttaaggaagttgttactaa

SEQ ID NO: 244593 - DNA, 22 bp, Artificial sequence
  SiRNA target sequence
cgttaaggaagttgttactaaa

SEQ ID NO: 244594 - DNA, 22 bp, Artificial sequence
  SiRNA target sequence
gttaaggaagttgttactaaat

SEQ ID NO: 244595 - DNA, 22 bp, Artificial sequence
  SiRNA target sequence
ttaaggaagttgttactaaata

SEQ ID NO: 244596 - DNA, 22 bp, Artificial sequence
  SiRNA target sequence
taaggaagttgttactaaatat

SEQ ID NO: 244597 - DNA, 22 bp, Artificial sequence
  SiRNA target sequence
aaggaagttgttactaaatatt

SEQ ID NO: 244598 - DNA, 22 bp, Artificial sequence
  SiRNA target sequence
aggaagttgttactaaatattt

SEQ ID NO: 244599 - DNA, 22 bp, Artificial sequence
  SiRNA target sequence
ggaagttgttactaaatatttt

SEQ ID NO: 244600 - DNA, 22 bp, Artificial sequence
  SiRNA target sequence
gaagttgttactaaatattttt

SEQ ID NO: 244601 - DNA, 22 bp, Artificial sequence
  SiRNA target sequence
aagttgttactaaatatttttg

SEQ ID NO: 244602 - DNA, 22 bp, Artificial sequence
  SiRNA target sequence
agttgttactaaatatttttga

SEQ ID NO: 244603 - DNA, 22 bp, Artificial sequence
  SiRNA target sequence
gttgttactaaatatttttgag

SEQ ID NO: 244604 - DNA, 22 bp, Artificial sequence
  SiRNA target sequence
ttgttactaaatatttttgaga

SEQ ID NO: 244605 - DNA, 22 bp, Artificial sequence
  SiRNA target sequence
tgttactaaatatttttgagaa

SEQ ID NO: 244606 - DNA, 22 bp, Artificial sequence
  SiRNA target sequence
gttactaaatatttttgagaat

SEQ ID NO: 244607 - DNA, 22 bp, Artificial sequence
  SiRNA target sequence
ttactaaatatttttgagaata

SEQ ID NO: 244608 - DNA, 22 bp, Artificial sequence
  SiRNA target sequence
tactaaatatttttgagaataa

SEQ ID NO: 244609 - DNA, 22 bp, Artificial sequence
  SiRNA target sequence
actaaatatttttgagaataat

SEQ ID NO: 244610 - DNA, 22 bp, Artificial sequence
  SiRNA target sequence
ctaaatatttttgagaataatc

SEQ ID NO: 244611 - DNA, 22 bp, Artificial sequence
  SiRNA target sequence
taaatatttttgagaataatct

SEQ ID NO: 244612 - DNA, 22 bp, Artificial sequence
  SiRNA target sequence
aaatatttttgagaataatctt

SEQ ID NO: 244613 - DNA, 22 bp, Artificial sequence
  SiRNA target sequence
aatatttttgagaataatcttt

SEQ ID NO: 244614 - DNA, 22 bp, Artificial sequence
  SiRNA target sequence
atatttttgagaataatctttc

SEQ ID NO: 244615 - DNA, 22 bp, Artificial sequence
  SiRNA target sequence
tatttttgagaataatctttcg

SEQ ID NO: 244616 - DNA, 22 bp, Artificial sequence
  SiRNA target sequence
atttttgagaataatctttcgg

SEQ ID NO: 244617 - DNA, 22 bp, Artificial sequence
  SiRNA target sequence
tttttgagaataatctttcgga

SEQ ID NO: 244618 - DNA, 22 bp, Artificial sequence
  SiRNA target sequence
ttttgagaataatctttcggag

SEQ ID NO: 244619 - DNA, 22 bp, Artificial sequence
  SiRNA target sequence
tttgagaataatctttcggagg

SEQ ID NO: 244620 - DNA, 22 bp, Artificial sequence
  SiRNA target sequence
ttgagaataatctttcggaggc

SEQ ID NO: 244621 - DNA, 22 bp, Artificial sequence
  SiRNA target sequence
tgagaataatctttcggaggca

SEQ ID NO: 244622 - DNA, 22 bp, Artificial sequence
  SiRNA target sequence
gagaataatctttcggaggcat

SEQ ID NO: 244623 - DNA, 22 bp, Artificial sequence
  SiRNA target sequence
agaataatctttcggaggcata

SEQ ID NO: 244624 - DNA, 22 bp, Artificial sequence
  SiRNA target sequence
gaataatctttcggaggcatat

SEQ ID NO: 244625 - DNA, 22 bp, Artificial sequence
  SiRNA target sequence
aataatctttcggaggcatatt

SEQ ID NO: 244626 - DNA, 22 bp, Artificial sequence
  SiRNA target sequence
ataatctttcggaggcatatta

SEQ ID NO: 244627 - DNA, 22 bp, Artificial sequence
  SiRNA target sequence
taatctttcggaggcatattat

SEQ ID NO: 244628 - DNA, 22 bp, Artificial sequence
  SiRNA target sequence
aatctttcggaggcatattatt

SEQ ID NO: 244629 - DNA, 22 bp, Artificial sequence
  SiRNA target sequence
atctttcggaggcatattatta

SEQ ID NO: 244630 - DNA, 22 bp, Artificial sequence
  SiRNA target sequence
tctttcggaggcatattattaa

SEQ ID NO: 244631 - DNA, 22 bp, Artificial sequence
  SiRNA target sequence
ctttcggaggcatattattaat

SEQ ID NO: 244632 - DNA, 22 bp, Artificial sequence
  SiRNA target sequence
tttcggaggcatattattaatt

SEQ ID NO: 244633 - DNA, 22 bp, Artificial sequence
  SiRNA target sequence
ttcggaggcatattattaattc

SEQ ID NO: 244634 - DNA, 22 bp, Artificial sequence
  SiRNA target sequence
tcggaggcatattattaattct

SEQ ID NO: 244635 - DNA, 22 bp, Artificial sequence
  SiRNA target sequence
cggaggcatattattaattctg

SEQ ID NO: 244636 - DNA, 22 bp, Artificial sequence
  SiRNA target sequence
ggaggcatattattaattctgc

SEQ ID NO: 244637 - DNA, 22 bp, Artificial sequence
  SiRNA target sequence
gaggcatattattaattctgct

SEQ ID NO: 244638 - DNA, 22 bp, Artificial sequence
  SiRNA target sequence
aggcatattattaattctgctt

SEQ ID NO: 244639 - DNA, 22 bp, Artificial sequence
  SiRNA target sequence
ggcatattattaattctgcttc

SEQ ID NO: 244640 - DNA, 22 bp, Artificial sequence
  SiRNA target sequence
gcatattattaattctgcttcc

SEQ ID NO: 244641 - DNA, 22 bp, Artificial sequence
  SiRNA target sequence
catattattaattctgcttccc

SEQ ID NO: 244642 - DNA, 22 bp, Artificial sequence
  SiRNA target sequence
atattattaattctgcttcccg

SEQ ID NO: 244643 - DNA, 22 bp, Artificial sequence
  SiRNA target sequence
tattattaattctgcttcccgt

SEQ ID NO: 244644 - DNA, 22 bp, Artificial sequence
  SiRNA target sequence
attattaattctgcttcccgta

SEQ ID NO: 244645 - DNA, 22 bp, Artificial sequence
  SiRNA target sequence
ttattaattctgcttcccgtag

SEQ ID NO: 244646 - DNA, 22 bp, Artificial sequence
  SiRNA target sequence
tattaattctgcttcccgtaga

SEQ ID NO: 244647 - DNA, 22 bp, Artificial sequence
  SiRNA target sequence
attaattctgcttcccgtagat

SEQ ID NO: 244648 - DNA, 22 bp, Artificial sequence
  SiRNA target sequence
ttaattctgcttcccgtagata

SEQ ID NO: 244649 - DNA, 22 bp, Artificial sequence
  SiRNA target sequence
taattctgcttcccgtagataa

SEQ ID NO: 244650 - DNA, 22 bp, Artificial sequence
  SiRNA target sequence
aattctgcttcccgtagataaa

SEQ ID NO: 244651 - DNA, 22 bp, Artificial sequence
  SiRNA target sequence
attctgcttcccgtagataaag

SEQ ID NO: 244652 - DNA, 22 bp, Artificial sequence
  SiRNA target sequence
ttctgcttcccgtagataaaga

SEQ ID NO: 244653 - DNA, 22 bp, Artificial sequence
  SiRNA target sequence
tctgcttcccgtagataaagaa

SEQ ID NO: 244654 - DNA, 22 bp, Artificial sequence
  SiRNA target sequence
ctgcttcccgtagataaagaat

SEQ ID NO: 244655 - DNA, 22 bp, Artificial sequence
  SiRNA target sequence
tgcttcccgtagataaagaatt

SEQ ID NO: 244656 - DNA, 22 bp, Artificial sequence
  SiRNA target sequence
gcttcccgtagataaagaattt

SEQ ID NO: 244657 - DNA, 22 bp, Artificial sequence
  SiRNA target sequence
cttcccgtagataaagaatttt

SEQ ID NO: 244658 - DNA, 22 bp, Artificial sequence
  SiRNA target sequence
ttcccgtagataaagaattttt

SEQ ID NO: 244659 - DNA, 22 bp, Artificial sequence
  SiRNA target sequence
tcccgtagataaagaatttttt

SEQ ID NO: 244660 - DNA, 22 bp, Artificial sequence
  SiRNA target sequence
cccgtagataaagaatttttta

SEQ ID NO: 244661 - DNA, 22 bp, Artificial sequence
  SiRNA target sequence
ccgtagataaagaattttttaa

SEQ ID NO: 244662 - DNA, 22 bp, Artificial sequence
  SiRNA target sequence
cgtagataaagaattttttaag

SEQ ID NO: 244663 - DNA, 22 bp, Artificial sequence
  SiRNA target sequence
gtagataaagaattttttaagg

SEQ ID NO: 244664 - DNA, 22 bp, Artificial sequence
  SiRNA target sequence
tagataaagaattttttaagga

SEQ ID NO: 244665 - DNA, 22 bp, Artificial sequence
  SiRNA target sequence
agataaagaattttttaaggac

SEQ ID NO: 244666 - DNA, 22 bp, Artificial sequence
  SiRNA target sequence
gataaagaattttttaaggaca

SEQ ID NO: 244667 - DNA, 22 bp, Artificial sequence
  SiRNA target sequence
ataaagaattttttaaggacat

SEQ ID NO: 244668 - DNA, 22 bp, Artificial sequence
  SiRNA target sequence
taaagaattttttaaggacata

SEQ ID NO: 244669 - DNA, 22 bp, Artificial sequence
  SiRNA target sequence
aaagaattttttaaggacatat

SEQ ID NO: 244670 - DNA, 22 bp, Artificial sequence
  SiRNA target sequence
aagaattttttaaggacatatc

SEQ ID NO: 244671 - DNA, 22 bp, Artificial sequence
  SiRNA target sequence
agaattttttaaggacatatca

SEQ ID NO: 244672 - DNA, 22 bp, Artificial sequence
  SiRNA target sequence
gaattttttaaggacatatcaa

SEQ ID NO: 244673 - DNA, 22 bp, Artificial sequence
  SiRNA target sequence
aattttttaaggacatatcaat

SEQ ID NO: 244674 - DNA, 22 bp, Artificial sequence
  SiRNA target sequence
attttttaaggacatatcaata

SEQ ID NO: 244675 - DNA, 22 bp, Artificial sequence
  SiRNA target sequence
ttttttaaggacatatcaataa

SEQ ID NO: 244676 - DNA, 22 bp, Artificial sequence
  SiRNA target sequence
tttttaaggacatatcaataaa

SEQ ID NO: 244677 - DNA, 22 bp, Artificial sequence
  SiRNA target sequence
ttttaaggacatatcaataaat

SEQ ID NO: 244678 - DNA, 22 bp, Artificial sequence
  SiRNA target sequence
tttaaggacatatcaataaatc

SEQ ID NO: 244679 - DNA, 22 bp, Artificial sequence
  SiRNA target sequence
ttaaggacatatcaataaatcc

SEQ ID NO: 244680 - DNA, 22 bp, Artificial sequence
  SiRNA target sequence
taaggacatatcaataaatcct

SEQ ID NO: 244681 - DNA, 22 bp, Artificial sequence
  SiRNA target sequence
aaggacatatcaataaatcctg

SEQ ID NO: 244682 - DNA, 22 bp, Artificial sequence
  SiRNA target sequence
aggacatatcaataaatcctgc

SEQ ID NO: 244683 - DNA, 22 bp, Artificial sequence
  SiRNA target sequence
ggacatatcaataaatcctgca

SEQ ID NO: 244684 - DNA, 22 bp, Artificial sequence
  SiRNA target sequence
gacatatcaataaatcctgcat

SEQ ID NO: 244685 - DNA, 22 bp, Artificial sequence
  SiRNA target sequence
acatatcaataaatcctgcatt

SEQ ID NO: 244686 - DNA, 22 bp, Artificial sequence
  SiRNA target sequence
catatcaataaatcctgcatta

SEQ ID NO: 244687 - DNA, 22 bp, Artificial sequence
  SiRNA target sequence
atatcaataaatcctgcattaa

SEQ ID NO: 244688 - DNA, 22 bp, Artificial sequence
  SiRNA target sequence
tatcaataaatcctgcattaat

SEQ ID NO: 244689 - DNA, 22 bp, Artificial sequence
  SiRNA target sequence
atcaataaatcctgcattaata

SEQ ID NO: 244690 - DNA, 22 bp, Artificial sequence
  SiRNA target sequence
tcaataaatcctgcattaatag

SEQ ID NO: 244691 - DNA, 22 bp, Artificial sequence
  SiRNA target sequence
caataaatcctgcattaatagc

SEQ ID NO: 244692 - DNA, 22 bp, Artificial sequence
  SiRNA target sequence
aataaatcctgcattaatagca

SEQ ID NO: 244693 - DNA, 22 bp, Artificial sequence
  SiRNA target sequence
ataaatcctgcattaatagcat

SEQ ID NO: 244694 - DNA, 22 bp, Artificial sequence
  SiRNA target sequence
taaatcctgcattaatagcata

SEQ ID NO: 244695 - DNA, 22 bp, Artificial sequence
  SiRNA target sequence
aaatcctgcattaatagcatag

SEQ ID NO: 244696 - DNA, 22 bp, Artificial sequence
  SiRNA target sequence
aatcctgcattaatagcataga

SEQ ID NO: 244697 - DNA, 22 bp, Artificial sequence
  SiRNA target sequence
atcctgcattaatagcatagat

SEQ ID NO: 244698 - DNA, 22 bp, Artificial sequence
  SiRNA target sequence
tcctgcattaatagcatagatt

SEQ ID NO: 244699 - DNA, 22 bp, Artificial sequence
  SiRNA target sequence
cctgcattaatagcatagatta

SEQ ID NO: 244700 - DNA, 22 bp, Artificial sequence
  SiRNA target sequence
ctgcattaatagcatagattaa

SEQ ID NO: 244701 - DNA, 22 bp, Artificial sequence
  SiRNA target sequence
tgcattaatagcatagattaat

SEQ ID NO: 244702 - DNA, 22 bp, Artificial sequence
  SiRNA target sequence
gcattaatagcatagattaatg

SEQ ID NO: 244703 - DNA, 22 bp, Artificial sequence
  SiRNA target sequence
cattaatagcatagattaatgc

SEQ ID NO: 244704 - DNA, 22 bp, Artificial sequence
  SiRNA target sequence
attaatagcatagattaatgcc

SEQ ID NO: 244705 - DNA, 22 bp, Artificial sequence
  SiRNA target sequence
ttaatagcatagattaatgccg

SEQ ID NO: 244706 - DNA, 22 bp, Artificial sequence
  SiRNA target sequence
taatagcatagattaatgccgc

SEQ ID NO: 244707 - DNA, 22 bp, Artificial sequence
  SiRNA target sequence
aatagcatagattaatgccgct

SEQ ID NO: 244708 - DNA, 22 bp, Artificial sequence
  SiRNA target sequence
atagcatagattaatgccgctg

SEQ ID NO: 244709 - DNA, 22 bp, Artificial sequence
  SiRNA target sequence
tagcatagattaatgccgctgc

SEQ ID NO: 244710 - DNA, 22 bp, Artificial sequence
  SiRNA target sequence
agcatagattaatgccgctgca

SEQ ID NO: 244711 - DNA, 22 bp, Artificial sequence
  SiRNA target sequence
gcatagattaatgccgctgcac

SEQ ID NO: 244712 - DNA, 22 bp, Artificial sequence
  SiRNA target sequence
catagattaatgccgctgcaca

SEQ ID NO: 244713 - DNA, 22 bp, Artificial sequence
  SiRNA target sequence
atagattaatgccgctgcacac

SEQ ID NO: 244714 - DNA, 22 bp, Artificial sequence
  SiRNA target sequence
tagattaatgccgctgcacaca

SEQ ID NO: 244715 - DNA, 22 bp, Artificial sequence
  SiRNA target sequence
agattaatgccgctgcacacat

SEQ ID NO: 244716 - DNA, 22 bp, Artificial sequence
  SiRNA target sequence
gattaatgccgctgcacacata

SEQ ID NO: 244717 - DNA, 22 bp, Artificial sequence
  SiRNA target sequence
attaatgccgctgcacacatat

SEQ ID NO: 244718 - DNA, 22 bp, Artificial sequence
  SiRNA target sequence
ttaatgccgctgcacacatatt

SEQ ID NO: 244719 - DNA, 22 bp, Artificial sequence
  SiRNA target sequence
taatgccgctgcacacatattt

SEQ ID NO: 244720 - DNA, 22 bp, Artificial sequence
  SiRNA target sequence
aatgccgctgcacacatatttc

SEQ ID NO: 244721 - DNA, 22 bp, Artificial sequence
  SiRNA target sequence
atgccgctgcacacatatttct

SEQ ID NO: 244722 - DNA, 22 bp, Artificial sequence
  SiRNA target sequence
tgccgctgcacacatatttctt

SEQ ID NO: 244723 - DNA, 22 bp, Artificial sequence
  SiRNA target sequence
gccgctgcacacatatttctta

SEQ ID NO: 244724 - DNA, 22 bp, Artificial sequence
  SiRNA target sequence
ccgctgcacacatatttcttaa

SEQ ID NO: 244725 - DNA, 22 bp, Artificial sequence
  SiRNA target sequence
cgctgcacacatatttcttaaa

SEQ ID NO: 244726 - DNA, 22 bp, Artificial sequence
  SiRNA target sequence
gctgcacacatatttcttaaaa

SEQ ID NO: 244727 - DNA, 22 bp, Artificial sequence
  SiRNA target sequence
ctgcacacatatttcttaaaaa

SEQ ID NO: 244728 - DNA, 22 bp, Artificial sequence
  SiRNA target sequence
tgcacacatatttcttaaaaat

SEQ ID NO: 244729 - DNA, 22 bp, Artificial sequence
  SiRNA target sequence
gcacacatatttcttaaaaatt

SEQ ID NO: 244730 - DNA, 22 bp, Artificial sequence
  SiRNA target sequence
cacacatatttcttaaaaattt

SEQ ID NO: 244731 - DNA, 22 bp, Artificial sequence
  SiRNA target sequence
acacatatttcttaaaaatttg

SEQ ID NO: 244732 - DNA, 22 bp, Artificial sequence
  SiRNA target sequence
cacatatttcttaaaaatttgg

SEQ ID NO: 244733 - DNA, 22 bp, Artificial sequence
  SiRNA target sequence
acatatttcttaaaaatttgga

SEQ ID NO: 244734 - DNA, 22 bp, Artificial sequence
  SiRNA target sequence
catatttcttaaaaatttggat

SEQ ID NO: 244735 - DNA, 22 bp, Artificial sequence
  SiRNA target sequence
atatttcttaaaaatttggatt

SEQ ID NO: 244736 - DNA, 22 bp, Artificial sequence
  SiRNA target sequence
tatttcttaaaaatttggattg

SEQ ID NO: 244737 - DNA, 22 bp, Artificial sequence
  SiRNA target sequence
atttcttaaaaatttggattgt

SEQ ID NO: 244738 - DNA, 22 bp, Artificial sequence
  SiRNA target sequence
tttcttaaaaatttggattgta

SEQ ID NO: 244739 - DNA, 22 bp, Artificial sequence
  SiRNA target sequence
ttcttaaaaatttggattgtaa

SEQ ID NO: 244740 - DNA, 22 bp, Artificial sequence
  SiRNA target sequence
tcttaaaaatttggattgtaaa

SEQ ID NO: 244741 - DNA, 22 bp, Artificial sequence
  SiRNA target sequence
cttaaaaatttggattgtaaaa

SEQ ID NO: 244742 - DNA, 22 bp, Artificial sequence
  SiRNA target sequence
ttaaaaatttggattgtaaaag

SEQ ID NO: 244743 - DNA, 22 bp, Artificial sequence
  SiRNA target sequence
taaaaatttggattgtaaaaga

SEQ ID NO: 244744 - DNA, 22 bp, Artificial sequence
  SiRNA target sequence
aaaaatttggattgtaaaagat

SEQ ID NO: 244745 - DNA, 22 bp, Artificial sequence
  SiRNA target sequence
aaaatttggattgtaaaagatc

SEQ ID NO: 244746 - DNA, 22 bp, Artificial sequence
  SiRNA target sequence
aaatttggattgtaaaagatca

SEQ ID NO: 244747 - DNA, 22 bp, Artificial sequence
  SiRNA target sequence
aatttggattgtaaaagatcaa

SEQ ID NO: 244748 - DNA, 22 bp, Artificial sequence
  SiRNA target sequence
atttggattgtaaaagatcaaa

SEQ ID NO: 244749 - DNA, 22 bp, Artificial sequence
  SiRNA target sequence
tttggattgtaaaagatcaaac

SEQ ID NO: 244750 - DNA, 22 bp, Artificial sequence
  SiRNA target sequence
ttggattgtaaaagatcaaacg

SEQ ID NO: 244751 - DNA, 22 bp, Artificial sequence
  SiRNA target sequence
tggattgtaaaagatcaaacga

SEQ ID NO: 244752 - DNA, 22 bp, Artificial sequence
  SiRNA target sequence
ggattgtaaaagatcaaacgag

SEQ ID NO: 244753 - DNA, 22 bp, Artificial sequence
  SiRNA target sequence
gattgtaaaagatcaaacgagg

SEQ ID NO: 244754 - DNA, 22 bp, Artificial sequence
  SiRNA target sequence
attgtaaaagatcaaacgagga

SEQ ID NO: 244755 - DNA, 22 bp, Artificial sequence
  SiRNA target sequence
ttgtaaaagatcaaacgaggat

SEQ ID NO: 244756 - DNA, 22 bp, Artificial sequence
  SiRNA target sequence
tgtaaaagatcaaacgaggatg

SEQ ID NO: 244757 - DNA, 22 bp, Artificial sequence
  SiRNA target sequence
gtaaaagatcaaacgaggatgt

SEQ ID NO: 244758 - DNA, 22 bp, Artificial sequence
  SiRNA target sequence
taaaagatcaaacgaggatgtc

SEQ ID NO: 244759 - DNA, 22 bp, Artificial sequence
  SiRNA target sequence
aaaagatcaaacgaggatgtcg

SEQ ID NO: 244760 - DNA, 22 bp, Artificial sequence
  SiRNA target sequence
aaagatcaaacgaggatgtcgt

SEQ ID NO: 244761 - DNA, 22 bp, Artificial sequence
  SiRNA target sequence
aagatcaaacgaggatgtcgtt

SEQ ID NO: 244762 - DNA, 22 bp, Artificial sequence
  SiRNA target sequence
agatcaaacgaggatgtcgttt

SEQ ID NO: 244763 - DNA, 22 bp, Artificial sequence
  SiRNA target sequence
gatcaaacgaggatgtcgtttt

SEQ ID NO: 244764 - DNA, 22 bp, Artificial sequence
  SiRNA target sequence
atcaaacgaggatgtcgttttg

SEQ ID NO: 244765 - DNA, 22 bp, Artificial sequence
  SiRNA target sequence
tcaaacgaggatgtcgttttgt

SEQ ID NO: 244766 - DNA, 22 bp, Artificial sequence
  SiRNA target sequence
caaacgaggatgtcgttttgtc

SEQ ID NO: 244767 - DNA, 22 bp, Artificial sequence
  SiRNA target sequence
aaacgaggatgtcgttttgtct

SEQ ID NO: 244768 - DNA, 22 bp, Artificial sequence
  SiRNA target sequence
aacgaggatgtcgttttgtctt

SEQ ID NO: 244769 - DNA, 22 bp, Artificial sequence
  SiRNA target sequence
acgaggatgtcgttttgtcttc

SEQ ID NO: 244770 - DNA, 22 bp, Artificial sequence
  SiRNA target sequence
cgaggatgtcgttttgtcttct

SEQ ID NO: 244771 - DNA, 22 bp, Artificial sequence
  SiRNA target sequence
gaggatgtcgttttgtcttctt

SEQ ID NO: 244772 - DNA, 22 bp, Artificial sequence
  SiRNA target sequence
aggatgtcgttttgtcttcttc

SEQ ID NO: 244773 - DNA, 22 bp, Artificial sequence
  SiRNA target sequence
ggatgtcgttttgtcttcttct

SEQ ID NO: 244774 - DNA, 22 bp, Artificial sequence
  SiRNA target sequence
gatgtcgttttgtcttcttctt

SEQ ID NO: 244775 - DNA, 22 bp, Artificial sequence
  SiRNA target sequence
atgtcgttttgtcttcttcttt

SEQ ID NO: 244776 - DNA, 22 bp, Artificial sequence
  SiRNA target sequence
tgtcgttttgtcttcttcttta

SEQ ID NO: 244777 - DNA, 22 bp, Artificial sequence
  SiRNA target sequence
gtcgttttgtcttcttctttat

SEQ ID NO: 244778 - DNA, 22 bp, Artificial sequence
  SiRNA target sequence
tcgttttgtcttcttctttatt

SEQ ID NO: 244779 - DNA, 22 bp, Artificial sequence
  SiRNA target sequence
cgttttgtcttcttctttattt

SEQ ID NO: 244780 - DNA, 22 bp, Artificial sequence
  SiRNA target sequence
gttttgtcttcttctttattta

SEQ ID NO: 244781 - DNA, 22 bp, Artificial sequence
  SiRNA target sequence
ttttgtcttcttctttatttat

SEQ ID NO: 244782 - DNA, 22 bp, Artificial sequence
  SiRNA target sequence
tttgtcttcttctttatttata

SEQ ID NO: 244783 - DNA, 22 bp, Artificial sequence
  SiRNA target sequence
ttgtcttcttctttatttatag

SEQ ID NO: 244784 - DNA, 22 bp, Artificial sequence
  SiRNA target sequence
tgtcttcttctttatttatagt

SEQ ID NO: 244785 - DNA, 22 bp, Artificial sequence
  SiRNA target sequence
gtcttcttctttatttatagtt

SEQ ID NO: 244786 - DNA, 22 bp, Artificial sequence
  SiRNA target sequence
tcttcttctttatttatagttt

SEQ ID NO: 244787 - DNA, 22 bp, Artificial sequence
  SiRNA target sequence
cttcttctttatttatagtttc

SEQ ID NO: 244788 - DNA, 22 bp, Artificial sequence
  SiRNA target sequence
ttcttctttatttatagtttcc

SEQ ID NO: 244789 - DNA, 22 bp, Artificial sequence
  SiRNA target sequence
tcttctttatttatagtttcct

SEQ ID NO: 244790 - DNA, 22 bp, Artificial sequence
  SiRNA target sequence
cttctttatttatagtttcctt

SEQ ID NO: 244791 - DNA, 22 bp, Artificial sequence
  SiRNA target sequence
ttctttatttatagtttccttt

SEQ ID NO: 244792 - DNA, 22 bp, Artificial sequence
  SiRNA target sequence
tctttatttatagtttccttta

SEQ ID NO: 244793 - DNA, 22 bp, Artificial sequence
  SiRNA target sequence
ctttatttatagtttcctttat

SEQ ID NO: 244794 - DNA, 22 bp, Artificial sequence
  SiRNA target sequence
tttatttatagtttcctttatt

SEQ ID NO: 244795 - DNA, 22 bp, Artificial sequence
  SiRNA target sequence
ttatttatagtttcctttattt

SEQ ID NO: 244796 - DNA, 22 bp, Artificial sequence
  SiRNA target sequence
tatttatagtttcctttatttc

SEQ ID NO: 244797 - DNA, 22 bp, Artificial sequence
  SiRNA target sequence
atttatagtttcctttatttct

SEQ ID NO: 244798 - DNA, 22 bp, Artificial sequence
  SiRNA target sequence
tttatagtttcctttatttctt

SEQ ID NO: 244799 - DNA, 22 bp, Artificial sequence
  SiRNA target sequence
ttatagtttcctttatttcttt

SEQ ID NO: 244800 - DNA, 22 bp, Artificial sequence
  SiRNA target sequence
tatagtttcctttatttcttta

SEQ ID NO: 244801 - DNA, 22 bp, Artificial sequence
  SiRNA target sequence
atagtttcctttatttctttag

SEQ ID NO: 244802 - DNA, 22 bp, Artificial sequence
  SiRNA target sequence
tagtttcctttatttctttagt

SEQ ID NO: 244803 - DNA, 22 bp, Artificial sequence
  SiRNA target sequence
agtttcctttatttctttagtt

SEQ ID NO: 244804 - DNA, 22 bp, Artificial sequence
  SiRNA target sequence
gtttcctttatttctttagttt

SEQ ID NO: 244805 - DNA, 22 bp, Artificial sequence
  SiRNA target sequence
tttcctttatttctttagtttt

SEQ ID NO: 244806 - DNA, 22 bp, Artificial sequence
  SiRNA target sequence
ttcctttatttctttagtttta

SEQ ID NO: 244807 - DNA, 22 bp, Artificial sequence
  SiRNA target sequence
tcctttatttctttagttttaa

SEQ ID NO: 244808 - DNA, 22 bp, Artificial sequence
  SiRNA target sequence
cctttatttctttagttttaag

SEQ ID NO: 244809 - DNA, 22 bp, Artificial sequence
  SiRNA target sequence
ctttatttctttagttttaaga

SEQ ID NO: 244810 - DNA, 22 bp, Artificial sequence
  SiRNA target sequence
tttatttctttagttttaagag

SEQ ID NO: 244811 - DNA, 22 bp, Artificial sequence
  SiRNA target sequence
ttatttctttagttttaagagg

SEQ ID NO: 244812 - DNA, 22 bp, Artificial sequence
  SiRNA target sequence
tatttctttagttttaagagga

SEQ ID NO: 244813 - DNA, 22 bp, Artificial sequence
  SiRNA target sequence
atttctttagttttaagaggaa

SEQ ID NO: 244814 - DNA, 22 bp, Artificial sequence
  SiRNA target sequence
tttctttagttttaagaggaat

SEQ ID NO: 244815 - DNA, 22 bp, Artificial sequence
  SiRNA target sequence
ttctttagttttaagaggaata

SEQ ID NO: 244816 - DNA, 22 bp, Artificial sequence
  SiRNA target sequence
tctttagttttaagaggaatat

SEQ ID NO: 244817 - DNA, 22 bp, Artificial sequence
  SiRNA target sequence
ctttagttttaagaggaatata

SEQ ID NO: 244818 - DNA, 22 bp, Artificial sequence
  SiRNA target sequence
tttagttttaagaggaatataa

SEQ ID NO: 244819 - DNA, 22 bp, Artificial sequence
  SiRNA target sequence
ttagttttaagaggaatataac

SEQ ID NO: 244820 - DNA, 22 bp, Artificial sequence
  SiRNA target sequence
tagttttaagaggaatataact

SEQ ID NO: 244821 - DNA, 22 bp, Artificial sequence
  SiRNA target sequence
agttttaagaggaatataactt

SEQ ID NO: 244822 - DNA, 22 bp, Artificial sequence
  SiRNA target sequence
gttttaagaggaatataacttt

SEQ ID NO: 244823 - DNA, 22 bp, Artificial sequence
  SiRNA target sequence
ttttaagaggaatataactttt

SEQ ID NO: 244824 - DNA, 22 bp, Artificial sequence
  SiRNA target sequence
tttaagaggaatataacttttt

SEQ ID NO: 244825 - DNA, 22 bp, Artificial sequence
  SiRNA target sequence
ttaagaggaatataacttttta

SEQ ID NO: 244826 - DNA, 22 bp, Artificial sequence
  SiRNA target sequence
taagaggaatataactttttaa

SEQ ID NO: 244827 - DNA, 22 bp, Artificial sequence
  SiRNA target sequence
aagaggaatataactttttaaa

SEQ ID NO: 244828 - DNA, 22 bp, Artificial sequence
  SiRNA target sequence
agaggaatataactttttaaaa

SEQ ID NO: 244829 - DNA, 22 bp, Artificial sequence
  SiRNA target sequence
gaggaatataactttttaaaaa

SEQ ID NO: 244830 - DNA, 22 bp, Artificial sequence
  SiRNA target sequence
aggaatataactttttaaaaag

SEQ ID NO: 244831 - DNA, 22 bp, Artificial sequence
  SiRNA target sequence
ggaatataactttttaaaaagt

SEQ ID NO: 244832 - DNA, 22 bp, Artificial sequence
  SiRNA target sequence
gaatataactttttaaaaagta

SEQ ID NO: 244833 - DNA, 22 bp, Artificial sequence
  SiRNA target sequence
aatataactttttaaaaagtaa

SEQ ID NO: 244834 - DNA, 22 bp, Artificial sequence
  SiRNA target sequence
atataactttttaaaaagtaaa

SEQ ID NO: 244835 - DNA, 22 bp, Artificial sequence
  SiRNA target sequence
tataactttttaaaaagtaaat

SEQ ID NO: 244836 - DNA, 22 bp, Artificial sequence
  SiRNA target sequence
ataactttttaaaaagtaaatt

SEQ ID NO: 244837 - DNA, 22 bp, Artificial sequence
  SiRNA target sequence
taactttttaaaaagtaaatta

SEQ ID NO: 244838 - DNA, 22 bp, Artificial sequence
  SiRNA target sequence
aactttttaaaaagtaaattaa

SEQ ID NO: 244839 - DNA, 22 bp, Artificial sequence
  SiRNA target sequence
actttttaaaaagtaaattaat

SEQ ID NO: 244840 - DNA, 22 bp, Artificial sequence
  SiRNA target sequence
ctttttaaaaagtaaattaatg

SEQ ID NO: 244841 - DNA, 22 bp, Artificial sequence
  SiRNA target sequence
tttttaaaaagtaaattaatgt

SEQ ID NO: 244842 - DNA, 22 bp, Artificial sequence
  SiRNA target sequence
ttttaaaaagtaaattaatgta

SEQ ID NO: 244843 - DNA, 22 bp, Artificial sequence
  SiRNA target sequence
tttaaaaagtaaattaatgtag

SEQ ID NO: 244844 - DNA, 22 bp, Artificial sequence
  SiRNA target sequence
ttaaaaagtaaattaatgtagt

SEQ ID NO: 244845 - DNA, 22 bp, Artificial sequence
  SiRNA target sequence
taaaaagtaaattaatgtagtt

SEQ ID NO: 244846 - DNA, 22 bp, Artificial sequence
  SiRNA target sequence
aaaaagtaaattaatgtagtta

SEQ ID NO: 244847 - DNA, 22 bp, Artificial sequence
  SiRNA target sequence
aaaagtaaattaatgtagttac

SEQ ID NO: 244848 - DNA, 22 bp, Artificial sequence
  SiRNA target sequence
aaagtaaattaatgtagttaca

SEQ ID NO: 244849 - DNA, 22 bp, Artificial sequence
  SiRNA target sequence
aagtaaattaatgtagttacaa

SEQ ID NO: 244850 - DNA, 22 bp, Artificial sequence
  SiRNA target sequence
agtaaattaatgtagttacaaa

SEQ ID NO: 244851 - DNA, 22 bp, Artificial sequence
  SiRNA target sequence
gtaaattaatgtagttacaaaa

SEQ ID NO: 244852 - DNA, 22 bp, Artificial sequence
  SiRNA target sequence
taaattaatgtagttacaaaag

SEQ ID NO: 244853 - DNA, 22 bp, Artificial sequence
  SiRNA target sequence
aaattaatgtagttacaaaaga

SEQ ID NO: 244854 - DNA, 22 bp, Artificial sequence
  SiRNA target sequence
aattaatgtagttacaaaagac

SEQ ID NO: 244855 - DNA, 22 bp, Artificial sequence
  SiRNA target sequence
attaatgtagttacaaaagaca

SEQ ID NO: 244856 - DNA, 22 bp, Artificial sequence
  SiRNA target sequence
ttaatgtagttacaaaagacaa

SEQ ID NO: 244857 - DNA, 22 bp, Artificial sequence
  SiRNA target sequence
taatgtagttacaaaagacaag

SEQ ID NO: 244858 - DNA, 22 bp, Artificial sequence
  SiRNA target sequence
aatgtagttacaaaagacaaga

SEQ ID NO: 244859 - DNA, 22 bp, Artificial sequence
  SiRNA target sequence
atgtagttacaaaagacaagat

SEQ ID NO: 244860 - DNA, 22 bp, Artificial sequence
  SiRNA target sequence
tgtagttacaaaagacaagatc

SEQ ID NO: 244861 - DNA, 22 bp, Artificial sequence
  SiRNA target sequence
gtagttacaaaagacaagatca

SEQ ID NO: 244862 - DNA, 22 bp, Artificial sequence
  SiRNA target sequence
tagttacaaaagacaagatcaa

SEQ ID NO: 244863 - DNA, 22 bp, Artificial sequence
  SiRNA target sequence
agttacaaaagacaagatcaaa

SEQ ID NO: 244864 - DNA, 22 bp, Artificial sequence
  SiRNA target sequence
gttacaaaagacaagatcaaaa

SEQ ID NO: 244865 - DNA, 22 bp, Artificial sequence
  SiRNA target sequence
ttacaaaagacaagatcaaaaa

SEQ ID NO: 244866 - DNA, 22 bp, Artificial sequence
  SiRNA target sequence
tacaaaagacaagatcaaaaaa

SEQ ID NO: 244867 - DNA, 22 bp, Artificial sequence
  SiRNA target sequence
acaaaagacaagatcaaaaaaa

SEQ ID NO: 244868 - DNA, 22 bp, Artificial sequence
  SiRNA target sequence
caaaagacaagatcaaaaaaaa

SEQ ID NO: 244869 - DNA, 22 bp, Artificial sequence
  SiRNA target sequence
aaaagacaagatcaaaaaaaac

SEQ ID NO: 244870 - DNA, 22 bp, Artificial sequence
  SiRNA target sequence
aaagacaagatcaaaaaaaaca

SEQ ID NO: 244871 - DNA, 22 bp, Artificial sequence
  SiRNA target sequence
aagacaagatcaaaaaaaacaa

SEQ ID NO: 244872 - DNA, 22 bp, Artificial sequence
  SiRNA target sequence
agacaagatcaaaaaaaacaaa

SEQ ID NO: 244873 - DNA, 22 bp, Artificial sequence
  SiRNA target sequence
gacaagatcaaaaaaaacaaac

SEQ ID NO: 244874 - DNA, 22 bp, Artificial sequence
  SiRNA target sequence
acaagatcaaaaaaaacaaact

SEQ ID NO: 244875 - DNA, 22 bp, Artificial sequence
  SiRNA target sequence
caagatcaaaaaaaacaaacta

SEQ ID NO: 244876 - DNA, 22 bp, Artificial sequence
  SiRNA target sequence
aagatcaaaaaaaacaaactac

SEQ ID NO: 244877 - DNA, 22 bp, Artificial sequence
  SiRNA target sequence
agatcaaaaaaaacaaactact

SEQ ID NO: 244878 - DNA, 22 bp, Artificial sequence
  SiRNA target sequence
gatcaaaaaaaacaaactacta

SEQ ID NO: 244879 - DNA, 22 bp, Artificial sequence
  SiRNA target sequence
atcaaaaaaaacaaactactac

SEQ ID NO: 244880 - DNA, 22 bp, Artificial sequence
  SiRNA target sequence
tcaaaaaaaacaaactactacc

SEQ ID NO: 244881 - DNA, 22 bp, Artificial sequence
  SiRNA target sequence
caaaaaaaacaaactactaccg

SEQ ID NO: 244882 - DNA, 22 bp, Artificial sequence
  SiRNA target sequence
aaaaaaaacaaactactaccgt

SEQ ID NO: 244883 - DNA, 22 bp, Artificial sequence
  SiRNA target sequence
aaaaaaacaaactactaccgtc

SEQ ID NO: 244884 - DNA, 22 bp, Artificial sequence
  SiRNA target sequence
aaaaaacaaactactaccgtca

SEQ ID NO: 244885 - DNA, 22 bp, Artificial sequence
  SiRNA target sequence
aaaaacaaactactaccgtcaa

SEQ ID NO: 244886 - DNA, 22 bp, Artificial sequence
  SiRNA target sequence
aaaacaaactactaccgtcaat

SEQ ID NO: 244887 - DNA, 22 bp, Artificial sequence
  SiRNA target sequence
aaacaaactactaccgtcaatt

SEQ ID NO: 244888 - DNA, 22 bp, Artificial sequence
  SiRNA target sequence
aacaaactactaccgtcaattt

SEQ ID NO: 244889 - DNA, 22 bp, Artificial sequence
  SiRNA target sequence
acaaactactaccgtcaatttt

SEQ ID NO: 244890 - DNA, 22 bp, Artificial sequence
  SiRNA target sequence
caaactactaccgtcaatttta

SEQ ID NO: 244891 - DNA, 22 bp, Artificial sequence
  SiRNA target sequence
aaactactaccgtcaattttat

SEQ ID NO: 244892 - DNA, 22 bp, Artificial sequence
  SiRNA target sequence
aactactaccgtcaattttatc

SEQ ID NO: 244893 - DNA, 22 bp, Artificial sequence
  SiRNA target sequence
actactaccgtcaattttatca

SEQ ID NO: 244894 - DNA, 22 bp, Artificial sequence
  SiRNA target sequence
ctactaccgtcaattttatcat

SEQ ID NO: 244895 - DNA, 22 bp, Artificial sequence
  SiRNA target sequence
tactaccgtcaattttatcatg

SEQ ID NO: 244896 - DNA, 22 bp, Artificial sequence
  SiRNA target sequence
actaccgtcaattttatcatgc

SEQ ID NO: 244897 - DNA, 22 bp, Artificial sequence
  SiRNA target sequence
ctaccgtcaattttatcatgca

SEQ ID NO: 244898 - DNA, 22 bp, Artificial sequence
  SiRNA target sequence
taccgtcaattttatcatgcaa

SEQ ID NO: 244899 - DNA, 22 bp, Artificial sequence
  SiRNA target sequence
accgtcaattttatcatgcaaa

SEQ ID NO: 244900 - DNA, 22 bp, Artificial sequence
  SiRNA target sequence
ccgtcaattttatcatgcaaac

SEQ ID NO: 244901 - DNA, 22 bp, Artificial sequence
  SiRNA target sequence
cgtcaattttatcatgcaaacc

SEQ ID NO: 244902 - DNA, 22 bp, Artificial sequence
  SiRNA target sequence
gtcaattttatcatgcaaacct

SEQ ID NO: 244903 - DNA, 22 bp, Artificial sequence
  SiRNA target sequence
tcaattttatcatgcaaacctg

SEQ ID NO: 244904 - DNA, 22 bp, Artificial sequence
  SiRNA target sequence
caattttatcatgcaaacctgc

SEQ ID NO: 244905 - DNA, 22 bp, Artificial sequence
  SiRNA target sequence
aattttatcatgcaaacctgca

SEQ ID NO: 244906 - DNA, 22 bp, Artificial sequence
  SiRNA target sequence
attttatcatgcaaacctgcag

SEQ ID NO: 244907 - DNA, 22 bp, Artificial sequence
  SiRNA target sequence
ttttatcatgcaaacctgcagg

SEQ ID NO: 244908 - DNA, 22 bp, Artificial sequence
  SiRNA target sequence
tttatcatgcaaacctgcagga

SEQ ID NO: 244909 - DNA, 22 bp, Artificial sequence
  SiRNA target sequence
ttatcatgcaaacctgcaggaa

SEQ ID NO: 244910 - DNA, 22 bp, Artificial sequence
  SiRNA target sequence
tatcatgcaaacctgcaggaag

SEQ ID NO: 244911 - DNA, 22 bp, Artificial sequence
  SiRNA target sequence
atcatgcaaacctgcaggaagt

SEQ ID NO: 244912 - DNA, 22 bp, Artificial sequence
  SiRNA target sequence
tcatgcaaacctgcaggaagta

SEQ ID NO: 244913 - DNA, 22 bp, Artificial sequence
  SiRNA target sequence
catgcaaacctgcaggaagtat

SEQ ID NO: 244914 - DNA, 22 bp, Artificial sequence
  SiRNA target sequence
atgcaaacctgcaggaagtata

SEQ ID NO: 244915 - DNA, 22 bp, Artificial sequence
  SiRNA target sequence
tgcaaacctgcaggaagtatat

SEQ ID NO: 244916 - DNA, 22 bp, Artificial sequence
  SiRNA target sequence
gcaaacctgcaggaagtatatt

SEQ ID NO: 244917 - DNA, 22 bp, Artificial sequence
  SiRNA target sequence
caaacctgcaggaagtatattt

SEQ ID NO: 244918 - DNA, 22 bp, Artificial sequence
  SiRNA target sequence
aaacctgcaggaagtatatttg

SEQ ID NO: 244919 - DNA, 22 bp, Artificial sequence
  SiRNA target sequence
aacctgcaggaagtatatttgc

SEQ ID NO: 244920 - DNA, 22 bp, Artificial sequence
  SiRNA target sequence
acctgcaggaagtatatttgct

SEQ ID NO: 244921 - DNA, 22 bp, Artificial sequence
  SiRNA target sequence
cctgcaggaagtatatttgcta

SEQ ID NO: 244922 - DNA, 22 bp, Artificial sequence
  SiRNA target sequence
ctgcaggaagtatatttgctaa

SEQ ID NO: 244923 - DNA, 22 bp, Artificial sequence
  SiRNA target sequence
tgcaggaagtatatttgctaat

SEQ ID NO: 244924 - DNA, 22 bp, Artificial sequence
  SiRNA target sequence
gcaggaagtatatttgctaatt

SEQ ID NO: 244925 - DNA, 22 bp, Artificial sequence
  SiRNA target sequence
caggaagtatatttgctaattc

SEQ ID NO: 244926 - DNA, 22 bp, Artificial sequence
  SiRNA target sequence
aggaagtatatttgctaattca

SEQ ID NO: 244927 - DNA, 22 bp, Artificial sequence
  SiRNA target sequence
ggaagtatatttgctaattcat

SEQ ID NO: 244928 - DNA, 22 bp, Artificial sequence
  SiRNA target sequence
gaagtatatttgctaattcatc

SEQ ID NO: 244929 - DNA, 22 bp, Artificial sequence
  SiRNA target sequence
aagtatatttgctaattcatct

SEQ ID NO: 244930 - DNA, 22 bp, Artificial sequence
  SiRNA target sequence
agtatatttgctaattcatctt

SEQ ID NO: 244931 - DNA, 22 bp, Artificial sequence
  SiRNA target sequence
gtatatttgctaattcatcttt

SEQ ID NO: 244932 - DNA, 22 bp, Artificial sequence
  SiRNA target sequence
tatatttgctaattcatctttt

SEQ ID NO: 244933 - DNA, 22 bp, Artificial sequence
  SiRNA target sequence
atatttgctaattcatctttta

SEQ ID NO: 244934 - DNA, 22 bp, Artificial sequence
  SiRNA target sequence
tatttgctaattcatcttttat

SEQ ID NO: 244935 - DNA, 22 bp, Artificial sequence
  SiRNA target sequence
atttgctaattcatcttttata

SEQ ID NO: 244936 - DNA, 22 bp, Artificial sequence
  SiRNA target sequence
tttgctaattcatcttttatat

SEQ ID NO: 244937 - DNA, 22 bp, Artificial sequence
  SiRNA target sequence
ttgctaattcatcttttatata

SEQ ID NO: 244938 - DNA, 22 bp, Artificial sequence
  SiRNA target sequence
tgctaattcatcttttatataa

SEQ ID NO: 244939 - DNA, 22 bp, Artificial sequence
  SiRNA target sequence
gctaattcatcttttatataaa

SEQ ID NO: 244940 - DNA, 22 bp, Artificial sequence
  SiRNA target sequence
ctaattcatcttttatataaat

SEQ ID NO: 244941 - DNA, 22 bp, Artificial sequence
  SiRNA target sequence
taattcatcttttatataaata

SEQ ID NO: 244942 - DNA, 22 bp, Artificial sequence
  SiRNA target sequence
aattcatcttttatataaataa

SEQ ID NO: 244943 - DNA, 22 bp, Artificial sequence
  SiRNA target sequence
attcatcttttatataaataaa

SEQ ID NO: 244944 - DNA, 22 bp, Artificial sequence
  SiRNA target sequence
ttcatcttttatataaataaaa

SEQ ID NO: 244945 - DNA, 22 bp, Artificial sequence
  SiRNA target sequence
tcatcttttatataaataaaag

SEQ ID NO: 244946 - DNA, 22 bp, Artificial sequence
  SiRNA target sequence
catcttttatataaataaaagc

SEQ ID NO: 244947 - DNA, 22 bp, Artificial sequence
  SiRNA target sequence
atcttttatataaataaaagct

SEQ ID NO: 244948 - DNA, 22 bp, Artificial sequence
  SiRNA target sequence
tcttttatataaataaaagcta

SEQ ID NO: 244949 - DNA, 22 bp, Artificial sequence
  SiRNA target sequence
cttttatataaataaaagctac

SEQ ID NO: 244950 - DNA, 22 bp, Artificial sequence
  SiRNA target sequence
ttttatataaataaaagctaca

SEQ ID NO: 244951 - DNA, 22 bp, Artificial sequence
  SiRNA target sequence
tttatataaataaaagctacag

SEQ ID NO: 244952 - DNA, 22 bp, Artificial sequence
  SiRNA target sequence
ttatataaataaaagctacaga

SEQ ID NO: 244953 - DNA, 22 bp, Artificial sequence
  SiRNA target sequence
tatataaataaaagctacagaa

SEQ ID NO: 244954 - DNA, 22 bp, Artificial sequence
  SiRNA target sequence
atataaataaaagctacagaaa

SEQ ID NO: 244955 - DNA, 22 bp, Artificial sequence
  SiRNA target sequence
tataaataaaagctacagaaat

SEQ ID NO: 244956 - DNA, 22 bp, Artificial sequence
  SiRNA target sequence
ataaataaaagctacagaaata

SEQ ID NO: 244957 - DNA, 22 bp, Artificial sequence
  SiRNA target sequence
taaataaaagctacagaaataa

SEQ ID NO: 244958 - DNA, 22 bp, Artificial sequence
  SiRNA target sequence
aaataaaagctacagaaataat

SEQ ID NO: 244959 - DNA, 22 bp, Artificial sequence
  SiRNA target sequence
aataaaagctacagaaataatc

SEQ ID NO: 244960 - DNA, 22 bp, Artificial sequence
  SiRNA target sequence
ataaaagctacagaaataatca

SEQ ID NO: 244961 - DNA, 22 bp, Artificial sequence
  SiRNA target sequence
taaaagctacagaaataatcat

SEQ ID NO: 244962 - DNA, 22 bp, Artificial sequence
  SiRNA target sequence
aaaagctacagaaataatcatt

SEQ ID NO: 244963 - DNA, 22 bp, Artificial sequence
  SiRNA target sequence
aaagctacagaaataatcattg

SEQ ID NO: 244964 - DNA, 22 bp, Artificial sequence
  SiRNA target sequence
aagctacagaaataatcattga

SEQ ID NO: 244965 - DNA, 22 bp, Artificial sequence
  SiRNA target sequence
agctacagaaataatcattgaa

SEQ ID NO: 244966 - DNA, 22 bp, Artificial sequence
  SiRNA target sequence
gctacagaaataatcattgaaa

SEQ ID NO: 244967 - DNA, 22 bp, Artificial sequence
  SiRNA target sequence
ctacagaaataatcattgaaat

SEQ ID NO: 244968 - DNA, 22 bp, Artificial sequence
  SiRNA target sequence
tacagaaataatcattgaaatg

SEQ ID NO: 244969 - DNA, 22 bp, Artificial sequence
  SiRNA target sequence
acagaaataatcattgaaatgg

SEQ ID NO: 244970 - DNA, 22 bp, Artificial sequence
  SiRNA target sequence
cagaaataatcattgaaatggc

SEQ ID NO: 244971 - DNA, 22 bp, Artificial sequence
  SiRNA target sequence
agaaataatcattgaaatggcg

SEQ ID NO: 244972 - DNA, 22 bp, Artificial sequence
  SiRNA target sequence
gaaataatcattgaaatggcgg

SEQ ID NO: 244973 - DNA, 22 bp, Artificial sequence
  SiRNA target sequence
aaataatcattgaaatggcggt

SEQ ID NO: 244974 - DNA, 22 bp, Artificial sequence
  SiRNA target sequence
aataatcattgaaatggcggtg

SEQ ID NO: 244975 - DNA, 22 bp, Artificial sequence
  SiRNA target sequence
ataatcattgaaatggcggtga

SEQ ID NO: 244976 - DNA, 22 bp, Artificial sequence
  SiRNA target sequence
taatcattgaaatggcggtgat

SEQ ID NO: 244977 - DNA, 22 bp, Artificial sequence
  SiRNA target sequence
aatcattgaaatggcggtgatt

SEQ ID NO: 244978 - DNA, 22 bp, Artificial sequence
  SiRNA target sequence
atcattgaaatggcggtgattg

SEQ ID NO: 244979 - DNA, 22 bp, Artificial sequence
  SiRNA target sequence
tcattgaaatggcggtgattgt

SEQ ID NO: 244980 - DNA, 22 bp, Artificial sequence
  SiRNA target sequence
cattgaaatggcggtgattgtg

SEQ ID NO: 244981 - DNA, 22 bp, Artificial sequence
  SiRNA target sequence
attgaaatggcggtgattgtgg

SEQ ID NO: 244982 - DNA, 22 bp, Artificial sequence
  SiRNA target sequence
ttgaaatggcggtgattgtgga

SEQ ID NO: 244983 - DNA, 22 bp, Artificial sequence
  SiRNA target sequence
tgaaatggcggtgattgtggaa

SEQ ID NO: 244984 - DNA, 22 bp, Artificial sequence
  SiRNA target sequence
gaaatggcggtgattgtggaaa

SEQ ID NO: 244985 - DNA, 22 bp, Artificial sequence
  SiRNA target sequence
aaatggcggtgattgtggaaaa

SEQ ID NO: 244986 - DNA, 22 bp, Artificial sequence
  SiRNA target sequence
aatggcggtgattgtggaaaaa

SEQ ID NO: 244987 - DNA, 22 bp, Artificial sequence
  SiRNA target sequence
atggcggtgattgtggaaaaat

SEQ ID NO: 244988 - DNA, 22 bp, Artificial sequence
  SiRNA target sequence
tggcggtgattgtggaaaaatt

SEQ ID NO: 244989 - DNA, 22 bp, Artificial sequence
  SiRNA target sequence
ggcggtgattgtggaaaaatta

SEQ ID NO: 244990 - DNA, 22 bp, Artificial sequence
  SiRNA target sequence
gcggtgattgtggaaaaattag

SEQ ID NO: 244991 - DNA, 22 bp, Artificial sequence
  SiRNA target sequence
cggtgattgtggaaaaattagg

SEQ ID NO: 244992 - DNA, 22 bp, Artificial sequence
  SiRNA target sequence
ggtgattgtggaaaaattagga

SEQ ID NO: 244993 - DNA, 22 bp, Artificial sequence
  SiRNA target sequence
gtgattgtggaaaaattaggaa

SEQ ID NO: 244994 - DNA, 22 bp, Artificial sequence
  SiRNA target sequence
tgattgtggaaaaattaggaac

SEQ ID NO: 244995 - DNA, 22 bp, Artificial sequence
  SiRNA target sequence
gattgtggaaaaattaggaaca

SEQ ID NO: 244996 - DNA, 22 bp, Artificial sequence
  SiRNA target sequence
attgtggaaaaattaggaacaa

SEQ ID NO: 244997 - DNA, 22 bp, Artificial sequence
  SiRNA target sequence
ttgtggaaaaattaggaacaat

SEQ ID NO: 244998 - DNA, 22 bp, Artificial sequence
  SiRNA target sequence
tgtggaaaaattaggaacaatt

SEQ ID NO: 244999 - DNA, 22 bp, Artificial sequence
  SiRNA target sequence
gtggaaaaattaggaacaattt

SEQ ID NO: 245000 - DNA, 22 bp, Artificial sequence
  SiRNA target sequence
tggaaaaattaggaacaatttc

SEQ ID NO: 245001 - DNA, 22 bp, Artificial sequence
  SiRNA target sequence
ggaaaaattaggaacaatttct

SEQ ID NO: 245002 - DNA, 22 bp, Artificial sequence
  SiRNA target sequence
gaaaaattaggaacaatttctt

SEQ ID NO: 245003 - DNA, 22 bp, Artificial sequence
  SiRNA target sequence
aaaaattaggaacaatttcttt

SEQ ID NO: 245004 - DNA, 22 bp, Artificial sequence
  SiRNA target sequence
aaaattaggaacaatttctttc

SEQ ID NO: 245005 - DNA, 22 bp, Artificial sequence
  SiRNA target sequence
aaattaggaacaatttctttca

SEQ ID NO: 245006 - DNA, 22 bp, Artificial sequence
  SiRNA target sequence
aattaggaacaatttctttcat

SEQ ID NO: 245007 - DNA, 22 bp, Artificial sequence
  SiRNA target sequence
attaggaacaatttctttcatt

SEQ ID NO: 245008 - DNA, 22 bp, Artificial sequence
  SiRNA target sequence
ttaggaacaatttctttcattt

SEQ ID NO: 245009 - DNA, 22 bp, Artificial sequence
  SiRNA target sequence
taggaacaatttctttcatttc

SEQ ID NO: 245010 - DNA, 22 bp, Artificial sequence
  SiRNA target sequence
aggaacaatttctttcatttca

SEQ ID NO: 245011 - DNA, 22 bp, Artificial sequence
  SiRNA target sequence
ggaacaatttctttcatttcat

SEQ ID NO: 245012 - DNA, 22 bp, Artificial sequence
  SiRNA target sequence
gaacaatttctttcatttcatc

SEQ ID NO: 245013 - DNA, 22 bp, Artificial sequence
  SiRNA target sequence
aacaatttctttcatttcatct

SEQ ID NO: 245014 - DNA, 22 bp, Artificial sequence
  SiRNA target sequence
acaatttctttcatttcatctt

SEQ ID NO: 245015 - DNA, 22 bp, Artificial sequence
  SiRNA target sequence
caatttctttcatttcatcttc

SEQ ID NO: 245016 - DNA, 22 bp, Artificial sequence
  SiRNA target sequence
aatttctttcatttcatcttct

SEQ ID NO: 245017 - DNA, 22 bp, Artificial sequence
  SiRNA target sequence
atttctttcatttcatcttctg

SEQ ID NO: 245018 - DNA, 22 bp, Artificial sequence
  SiRNA target sequence
tttctttcatttcatcttctgt

SEQ ID NO: 245019 - DNA, 22 bp, Artificial sequence
  SiRNA target sequence
ttctttcatttcatcttctgta

SEQ ID NO: 245020 - DNA, 22 bp, Artificial sequence
  SiRNA target sequence
tctttcatttcatcttctgtac

SEQ ID NO: 245021 - DNA, 22 bp, Artificial sequence
  SiRNA target sequence
ctttcatttcatcttctgtaca

SEQ ID NO: 245022 - DNA, 22 bp, Artificial sequence
  SiRNA target sequence
tttcatttcatcttctgtacaa

SEQ ID NO: 245023 - DNA, 22 bp, Artificial sequence
  SiRNA target sequence
ttcatttcatcttctgtacaag

SEQ ID NO: 245024 - DNA, 22 bp, Artificial sequence
  SiRNA target sequence
tcatttcatcttctgtacaagc

SEQ ID NO: 245025 - DNA, 22 bp, Artificial sequence
  SiRNA target sequence
catttcatcttctgtacaagca

SEQ ID NO: 245026 - DNA, 22 bp, Artificial sequence
  SiRNA target sequence
atttcatcttctgtacaagcat

SEQ ID NO: 245027 - DNA, 22 bp, Artificial sequence
  SiRNA target sequence
tttcatcttctgtacaagcatg

SEQ ID NO: 245028 - DNA, 22 bp, Artificial sequence
  SiRNA target sequence
ttcatcttctgtacaagcatga

SEQ ID NO: 245029 - DNA, 22 bp, Artificial sequence
  SiRNA target sequence
tcatcttctgtacaagcatgat

SEQ ID NO: 245030 - DNA, 22 bp, Artificial sequence
  SiRNA target sequence
catcttctgtacaagcatgatt

SEQ ID NO: 245031 - DNA, 22 bp, Artificial sequence
  SiRNA target sequence
atcttctgtacaagcatgattg

SEQ ID NO: 245032 - DNA, 22 bp, Artificial sequence
  SiRNA target sequence
tcttctgtacaagcatgattgg

SEQ ID NO: 245033 - DNA, 22 bp, Artificial sequence
  SiRNA target sequence
cttctgtacaagcatgattggc

SEQ ID NO: 245034 - DNA, 22 bp, Artificial sequence
  SiRNA target sequence
ttctgtacaagcatgattggct

SEQ ID NO: 245035 - DNA, 22 bp, Artificial sequence
  SiRNA target sequence
tctgtacaagcatgattggcta

SEQ ID NO: 245036 - DNA, 22 bp, Artificial sequence
  SiRNA target sequence
ctgtacaagcatgattggctaa

SEQ ID NO: 245037 - DNA, 22 bp, Artificial sequence
  SiRNA target sequence
tgtacaagcatgattggctaac

SEQ ID NO: 245038 - DNA, 22 bp, Artificial sequence
  SiRNA target sequence
gtacaagcatgattggctaacg

SEQ ID NO: 245039 - DNA, 22 bp, Artificial sequence
  SiRNA target sequence
tacaagcatgattggctaacgc

SEQ ID NO: 245040 - DNA, 22 bp, Artificial sequence
  SiRNA target sequence
acaagcatgattggctaacgca

SEQ ID NO: 245041 - DNA, 22 bp, Artificial sequence
  SiRNA target sequence
caagcatgattggctaacgcat

SEQ ID NO: 245042 - DNA, 22 bp, Artificial sequence
  SiRNA target sequence
aagcatgattggctaacgcata

SEQ ID NO: 245043 - DNA, 22 bp, Artificial sequence
  SiRNA target sequence
agcatgattggctaacgcatat

SEQ ID NO: 245044 - DNA, 22 bp, Artificial sequence
  SiRNA target sequence
gcatgattggctaacgcatata

SEQ ID NO: 245045 - DNA, 22 bp, Artificial sequence
  SiRNA target sequence
catgattggctaacgcatataa

SEQ ID NO: 245046 - DNA, 22 bp, Artificial sequence
  SiRNA target sequence
atgattggctaacgcatataaa

SEQ ID NO: 245047 - DNA, 22 bp, Artificial sequence
  SiRNA target sequence
tgattggctaacgcatataaag

SEQ ID NO: 245048 - DNA, 22 bp, Artificial sequence
  SiRNA target sequence
gattggctaacgcatataaagc

SEQ ID NO: 245049 - DNA, 22 bp, Artificial sequence
  SiRNA target sequence
attggctaacgcatataaagca

SEQ ID NO: 245050 - DNA, 22 bp, Artificial sequence
  SiRNA target sequence
ttggctaacgcatataaagcaa

SEQ ID NO: 245051 - DNA, 22 bp, Artificial sequence
  SiRNA target sequence
tggctaacgcatataaagcaaa

SEQ ID NO: 245052 - DNA, 22 bp, Artificial sequence
  SiRNA target sequence
ggctaacgcatataaagcaaaa

SEQ ID NO: 245053 - DNA, 22 bp, Artificial sequence
  SiRNA target sequence
gctaacgcatataaagcaaaac

SEQ ID NO: 245054 - DNA, 22 bp, Artificial sequence
  SiRNA target sequence
ctaacgcatataaagcaaaacc

SEQ ID NO: 245055 - DNA, 22 bp, Artificial sequence
  SiRNA target sequence
taacgcatataaagcaaaacca

SEQ ID NO: 245056 - DNA, 22 bp, Artificial sequence
  SiRNA target sequence
aacgcatataaagcaaaaccaa

SEQ ID NO: 245057 - DNA, 22 bp, Artificial sequence
  SiRNA target sequence
acgcatataaagcaaaaccaac

SEQ ID NO: 245058 - DNA, 22 bp, Artificial sequence
  SiRNA target sequence
cgcatataaagcaaaaccaact

SEQ ID NO: 245059 - DNA, 22 bp, Artificial sequence
  SiRNA target sequence
gcatataaagcaaaaccaacta

SEQ ID NO: 245060 - DNA, 22 bp, Artificial sequence
  SiRNA target sequence
catataaagcaaaaccaactac

SEQ ID NO: 245061 - DNA, 22 bp, Artificial sequence
  SiRNA target sequence
atataaagcaaaaccaactact

SEQ ID NO: 245062 - DNA, 22 bp, Artificial sequence
  SiRNA target sequence
tataaagcaaaaccaactacta

SEQ ID NO: 245063 - DNA, 22 bp, Artificial sequence
  SiRNA target sequence
ataaagcaaaaccaactactag

SEQ ID NO: 245064 - DNA, 22 bp, Artificial sequence
  SiRNA target sequence
taaagcaaaaccaactactaga

SEQ ID NO: 245065 - DNA, 22 bp, Artificial sequence
  SiRNA target sequence
aaagcaaaaccaactactagag

SEQ ID NO: 245066 - DNA, 22 bp, Artificial sequence
  SiRNA target sequence
aagcaaaaccaactactagagt

SEQ ID NO: 245067 - DNA, 22 bp, Artificial sequence
  SiRNA target sequence
agcaaaaccaactactagagta

SEQ ID NO: 245068 - DNA, 22 bp, Artificial sequence
  SiRNA target sequence
gcaaaaccaactactagagtac

SEQ ID NO: 245069 - DNA, 22 bp, Artificial sequence
  SiRNA target sequence
caaaaccaactactagagtact

SEQ ID NO: 245070 - DNA, 22 bp, Artificial sequence
  SiRNA target sequence
aaaaccaactactagagtactc

SEQ ID NO: 245071 - DNA, 22 bp, Artificial sequence
  SiRNA target sequence
aaaccaactactagagtactcc

SEQ ID NO: 245072 - DNA, 22 bp, Artificial sequence
  SiRNA target sequence
aaccaactactagagtactcca

SEQ ID NO: 245073 - DNA, 22 bp, Artificial sequence
  SiRNA target sequence
accaactactagagtactccac

SEQ ID NO: 245074 - DNA, 22 bp, Artificial sequence
  SiRNA target sequence
ccaactactagagtactccaca

SEQ ID NO: 245075 - DNA, 22 bp, Artificial sequence
  SiRNA target sequence
caactactagagtactccacaa

SEQ ID NO: 245076 - DNA, 22 bp, Artificial sequence
  SiRNA target sequence
aactactagagtactccacaac

SEQ ID NO: 245077 - DNA, 22 bp, Artificial sequence
  SiRNA target sequence
actactagagtactccacaact

SEQ ID NO: 245078 - DNA, 22 bp, Artificial sequence
  SiRNA target sequence
ctactagagtactccacaactc

SEQ ID NO: 245079 - DNA, 22 bp, Artificial sequence
  SiRNA target sequence
tactagagtactccacaactcc

SEQ ID NO: 245080 - DNA, 22 bp, Artificial sequence
  SiRNA target sequence
actagagtactccacaactccg

SEQ ID NO: 245081 - DNA, 22 bp, Artificial sequence
  SiRNA target sequence
ctagagtactccacaactccga

SEQ ID NO: 245082 - DNA, 22 bp, Artificial sequence
  SiRNA target sequence
tagagtactccacaactccgat

SEQ ID NO: 245083 - DNA, 22 bp, Artificial sequence
  SiRNA target sequence
agagtactccacaactccgata

SEQ ID NO: 245084 - DNA, 22 bp, Artificial sequence
  SiRNA target sequence
gagtactccacaactccgataa

SEQ ID NO: 245085 - DNA, 22 bp, Artificial sequence
  SiRNA target sequence
agtactccacaactccgataag

SEQ ID NO: 245086 - DNA, 22 bp, Artificial sequence
  SiRNA target sequence
gtactccacaactccgataaga

SEQ ID NO: 245087 - DNA, 22 bp, Artificial sequence
  SiRNA target sequence
tactccacaactccgataagat

SEQ ID NO: 245088 - DNA, 22 bp, Artificial sequence
  SiRNA target sequence
actccacaactccgataagatg

SEQ ID NO: 245089 - DNA, 22 bp, Artificial sequence
  SiRNA target sequence
ctccacaactccgataagatgt

SEQ ID NO: 245090 - DNA, 22 bp, Artificial sequence
  SiRNA target sequence
tccacaactccgataagatgta

SEQ ID NO: 245091 - DNA, 22 bp, Artificial sequence
  SiRNA target sequence
ccacaactccgataagatgtaa

SEQ ID NO: 245092 - DNA, 22 bp, Artificial sequence
  SiRNA target sequence
cacaactccgataagatgtaac

SEQ ID NO: 245093 - DNA, 22 bp, Artificial sequence
  SiRNA target sequence
acaactccgataagatgtaaca

SEQ ID NO: 245094 - DNA, 22 bp, Artificial sequence
  SiRNA target sequence
caactccgataagatgtaacat

SEQ ID NO: 245095 - DNA, 22 bp, Artificial sequence
  SiRNA target sequence
aactccgataagatgtaacata

SEQ ID NO: 245096 - DNA, 22 bp, Artificial sequence
  SiRNA target sequence
actccgataagatgtaacataa

SEQ ID NO: 245097 - DNA, 22 bp, Artificial sequence
  SiRNA target sequence
ctccgataagatgtaacataaa

SEQ ID NO: 245098 - DNA, 22 bp, Artificial sequence
  SiRNA target sequence
tccgataagatgtaacataaag

SEQ ID NO: 245099 - DNA, 22 bp, Artificial sequence
  SiRNA target sequence
ccgataagatgtaacataaagt

SEQ ID NO: 245100 - DNA, 22 bp, Artificial sequence
  SiRNA target sequence
cgataagatgtaacataaagta

SEQ ID NO: 245101 - DNA, 22 bp, Artificial sequence
  SiRNA target sequence
gataagatgtaacataaagtac

SEQ ID NO: 245102 - DNA, 22 bp, Artificial sequence
  SiRNA target sequence
ataagatgtaacataaagtact

SEQ ID NO: 245103 - DNA, 22 bp, Artificial sequence
  SiRNA target sequence
taagatgtaacataaagtactt

SEQ ID NO: 245104 - DNA, 22 bp, Artificial sequence
  SiRNA target sequence
aagatgtaacataaagtactta

SEQ ID NO: 245105 - DNA, 22 bp, Artificial sequence
  SiRNA target sequence
agatgtaacataaagtacttat

SEQ ID NO: 245106 - DNA, 22 bp, Artificial sequence
  SiRNA target sequence
gatgtaacataaagtacttatc

SEQ ID NO: 245107 - DNA, 22 bp, Artificial sequence
  SiRNA target sequence
atgtaacataaagtacttatcc

SEQ ID NO: 245108 - DNA, 22 bp, Artificial sequence
  SiRNA target sequence
tgtaacataaagtacttatcca

SEQ ID NO: 245109 - DNA, 22 bp, Artificial sequence
  SiRNA target sequence
gtaacataaagtacttatccac

SEQ ID NO: 245110 - DNA, 22 bp, Artificial sequence
  SiRNA target sequence
taacataaagtacttatccact

SEQ ID NO: 245111 - DNA, 22 bp, Artificial sequence
  SiRNA target sequence
aacataaagtacttatccactc

SEQ ID NO: 245112 - DNA, 22 bp, Artificial sequence
  SiRNA target sequence
acataaagtacttatccactca

SEQ ID NO: 245113 - DNA, 22 bp, Artificial sequence
  SiRNA target sequence
cataaagtacttatccactcac

SEQ ID NO: 245114 - DNA, 22 bp, Artificial sequence
  SiRNA target sequence
ataaagtacttatccactcact

SEQ ID NO: 245115 - DNA, 22 bp, Artificial sequence
  SiRNA target sequence
taaagtacttatccactcactg

SEQ ID NO: 245116 - DNA, 22 bp, Artificial sequence
  SiRNA target sequence
aaagtacttatccactcactgt

SEQ ID NO: 245117 - DNA, 22 bp, Artificial sequence
  SiRNA target sequence
aagtacttatccactcactgta

SEQ ID NO: 245118 - DNA, 22 bp, Artificial sequence
  SiRNA target sequence
agtacttatccactcactgtac

SEQ ID NO: 245119 - DNA, 22 bp, Artificial sequence
  SiRNA target sequence
gtacttatccactcactgtaca

SEQ ID NO: 245120 - DNA, 22 bp, Artificial sequence
  SiRNA target sequence
tacttatccactcactgtacat

SEQ ID NO: 245121 - DNA, 22 bp, Artificial sequence
  SiRNA target sequence
acttatccactcactgtacata

SEQ ID NO: 245122 - DNA, 22 bp, Artificial sequence
  SiRNA target sequence
cttatccactcactgtacatat

SEQ ID NO: 245123 - DNA, 22 bp, Artificial sequence
  SiRNA target sequence
ttatccactcactgtacatata

SEQ ID NO: 245124 - DNA, 22 bp, Artificial sequence
  SiRNA target sequence
tatccactcactgtacatatat

SEQ ID NO: 245125 - DNA, 22 bp, Artificial sequence
  SiRNA target sequence
atccactcactgtacatatata

SEQ ID NO: 245126 - DNA, 22 bp, Artificial sequence
  SiRNA target sequence
tccactcactgtacatatataa

SEQ ID NO: 245127 - DNA, 22 bp, Artificial sequence
  SiRNA target sequence
ccactcactgtacatatataaa

SEQ ID NO: 245128 - DNA, 22 bp, Artificial sequence
  SiRNA target sequence
cactcactgtacatatataaaa

SEQ ID NO: 245129 - DNA, 22 bp, Artificial sequence
  SiRNA target sequence
actcactgtacatatataaaaa

SEQ ID NO: 245130 - DNA, 22 bp, Artificial sequence
  SiRNA target sequence
ctcactgtacatatataaaaaa

SEQ ID NO: 245131 - DNA, 22 bp, Artificial sequence
  SiRNA target sequence
tcactgtacatatataaaaaag

SEQ ID NO: 245132 - DNA, 22 bp, Artificial sequence
  SiRNA target sequence
cactgtacatatataaaaaagg

SEQ ID NO: 245133 - DNA, 22 bp, Artificial sequence
  SiRNA target sequence
actgtacatatataaaaaagga

SEQ ID NO: 245134 - DNA, 22 bp, Artificial sequence
  SiRNA target sequence
ctgtacatatataaaaaaggag

SEQ ID NO: 245135 - DNA, 22 bp, Artificial sequence
  SiRNA target sequence
tgtacatatataaaaaaggaga

SEQ ID NO: 245136 - DNA, 22 bp, Artificial sequence
  SiRNA target sequence
gtacatatataaaaaaggagat

SEQ ID NO: 245137 - DNA, 22 bp, Artificial sequence
  SiRNA target sequence
tacatatataaaaaaggagata

SEQ ID NO: 245138 - DNA, 22 bp, Artificial sequence
  SiRNA target sequence
acatatataaaaaaggagataa

SEQ ID NO: 245139 - DNA, 22 bp, Artificial sequence
  SiRNA target sequence
catatataaaaaaggagataag

SEQ ID NO: 245140 - DNA, 22 bp, Artificial sequence
  SiRNA target sequence
atatataaaaaaggagataagc

SEQ ID NO: 245141 - DNA, 22 bp, Artificial sequence
  SiRNA target sequence
tatataaaaaaggagataagcc

SEQ ID NO: 245142 - DNA, 22 bp, Artificial sequence
  SiRNA target sequence
atataaaaaaggagataagccc

SEQ ID NO: 245143 - DNA, 22 bp, Artificial sequence
  SiRNA target sequence
tataaaaaaggagataagccca

SEQ ID NO: 245144 - DNA, 22 bp, Artificial sequence
  SiRNA target sequence
ataaaaaaggagataagcccat

SEQ ID NO: 245145 - DNA, 22 bp, Artificial sequence
  SiRNA target sequence
taaaaaaggagataagcccatc

SEQ ID NO: 245146 - DNA, 22 bp, Artificial sequence
  SiRNA target sequence
aaaaaaggagataagcccatca

SEQ ID NO: 245147 - DNA, 22 bp, Artificial sequence
  SiRNA target sequence
aaaaaggagataagcccatcaa

SEQ ID NO: 245148 - DNA, 22 bp, Artificial sequence
  SiRNA target sequence
aaaaggagataagcccatcaag

SEQ ID NO: 245149 - DNA, 22 bp, Artificial sequence
  SiRNA target sequence
aaaggagataagcccatcaagc

SEQ ID NO: 245150 - DNA, 22 bp, Artificial sequence
  SiRNA target sequence
aaggagataagcccatcaagct

SEQ ID NO: 245151 - DNA, 22 bp, Artificial sequence
  SiRNA target sequence
aggagataagcccatcaagctt

SEQ ID NO: 245152 - DNA, 22 bp, Artificial sequence
  SiRNA target sequence
ggagataagcccatcaagcttc

SEQ ID NO: 245153 - DNA, 22 bp, Artificial sequence
  SiRNA target sequence
gagataagcccatcaagcttct

SEQ ID NO: 245154 - DNA, 22 bp, Artificial sequence
  SiRNA target sequence
agataagcccatcaagcttcta

SEQ ID NO: 245155 - DNA, 22 bp, Artificial sequence
  SiRNA target sequence
gataagcccatcaagcttctaa

SEQ ID NO: 245156 - DNA, 22 bp, Artificial sequence
  SiRNA target sequence
ataagcccatcaagcttctaac

SEQ ID NO: 245157 - DNA, 22 bp, Artificial sequence
  SiRNA target sequence
taagcccatcaagcttctaact

SEQ ID NO: 245158 - DNA, 22 bp, Artificial sequence
  SiRNA target sequence
aagcccatcaagcttctaactg

SEQ ID NO: 245159 - DNA, 22 bp, Artificial sequence
  SiRNA target sequence
agcccatcaagcttctaactga

SEQ ID NO: 245160 - DNA, 22 bp, Artificial sequence
  SiRNA target sequence
gcccatcaagcttctaactgac

SEQ ID NO: 245161 - DNA, 22 bp, Artificial sequence
  SiRNA target sequence
cccatcaagcttctaactgaca

SEQ ID NO: 245162 - DNA, 22 bp, Artificial sequence
  SiRNA target sequence
ccatcaagcttctaactgacat

SEQ ID NO: 245163 - DNA, 22 bp, Artificial sequence
  SiRNA target sequence
catcaagcttctaactgacatc

SEQ ID NO: 245164 - DNA, 22 bp, Artificial sequence
  SiRNA target sequence
atcaagcttctaactgacatct

SEQ ID NO: 245165 - DNA, 22 bp, Artificial sequence
  SiRNA target sequence
tcaagcttctaactgacatctt

SEQ ID NO: 245166 - DNA, 22 bp, Artificial sequence
  SiRNA target sequence
caagcttctaactgacatctta

SEQ ID NO: 245167 - DNA, 22 bp, Artificial sequence
  SiRNA target sequence
aagcttctaactgacatcttac

SEQ ID NO: 245168 - DNA, 22 bp, Artificial sequence
  SiRNA target sequence
agcttctaactgacatcttacc

SEQ ID NO: 245169 - DNA, 22 bp, Artificial sequence
  SiRNA target sequence
gcttctaactgacatcttacca

SEQ ID NO: 245170 - DNA, 22 bp, Artificial sequence
  SiRNA target sequence
cttctaactgacatcttaccat

SEQ ID NO: 245171 - DNA, 22 bp, Artificial sequence
  SiRNA target sequence
ttctaactgacatcttaccatc

SEQ ID NO: 245172 - DNA, 22 bp, Artificial sequence
  SiRNA target sequence
tctaactgacatcttaccatca

SEQ ID NO: 245173 - DNA, 22 bp, Artificial sequence
  SiRNA target sequence
ctaactgacatcttaccatcac

SEQ ID NO: 245174 - DNA, 22 bp, Artificial sequence
  SiRNA target sequence
taactgacatcttaccatcaca

SEQ ID NO: 245175 - DNA, 22 bp, Artificial sequence
  SiRNA target sequence
aactgacatcttaccatcacaa

SEQ ID NO: 245176 - DNA, 22 bp, Artificial sequence
  SiRNA target sequence
actgacatcttaccatcacaaa

SEQ ID NO: 245177 - DNA, 22 bp, Artificial sequence
  SiRNA target sequence
ctgacatcttaccatcacaaaa

SEQ ID NO: 245178 - DNA, 22 bp, Artificial sequence
  SiRNA target sequence
tgacatcttaccatcacaaaaa

SEQ ID NO: 245179 - DNA, 22 bp, Artificial sequence
  SiRNA target sequence
gacatcttaccatcacaaaaaa

SEQ ID NO: 245180 - DNA, 22 bp, Artificial sequence
  SiRNA target sequence
acatcttaccatcacaaaaaat

SEQ ID NO: 245181 - DNA, 22 bp, Artificial sequence
  SiRNA target sequence
catcttaccatcacaaaaaata

SEQ ID NO: 245182 - DNA, 22 bp, Artificial sequence
  SiRNA target sequence
atcttaccatcacaaaaaatat

SEQ ID NO: 245183 - DNA, 22 bp, Artificial sequence
  SiRNA target sequence
tcttaccatcacaaaaaatatc

SEQ ID NO: 245184 - DNA, 22 bp, Artificial sequence
  SiRNA target sequence
cttaccatcacaaaaaatatct

SEQ ID NO: 245185 - DNA, 22 bp, Artificial sequence
  SiRNA target sequence
ttaccatcacaaaaaatatcta

SEQ ID NO: 245186 - DNA, 22 bp, Artificial sequence
  SiRNA target sequence
taccatcacaaaaaatatctag

SEQ ID NO: 245187 - DNA, 22 bp, Artificial sequence
  SiRNA target sequence
accatcacaaaaaatatctagt

SEQ ID NO: 245188 - DNA, 22 bp, Artificial sequence
  SiRNA target sequence
ccatcacaaaaaatatctagtg

SEQ ID NO: 245189 - DNA, 22 bp, Artificial sequence
  SiRNA target sequence
catcacaaaaaatatctagtgc

SEQ ID NO: 245190 - DNA, 22 bp, Artificial sequence
  SiRNA target sequence
atcacaaaaaatatctagtgcc

SEQ ID NO: 245191 - DNA, 22 bp, Artificial sequence
  SiRNA target sequence
tcacaaaaaatatctagtgccc

SEQ ID NO: 245192 - DNA, 22 bp, Artificial sequence
  SiRNA target sequence
cacaaaaaatatctagtgccca

SEQ ID NO: 245193 - DNA, 22 bp, Artificial sequence
  SiRNA target sequence
acaaaaaatatctagtgcccat

SEQ ID NO: 245194 - DNA, 22 bp, Artificial sequence
  SiRNA target sequence
caaaaaatatctagtgcccatt

SEQ ID NO: 245195 - DNA, 22 bp, Artificial sequence
  SiRNA target sequence
aaaaaatatctagtgcccattg

SEQ ID NO: 245196 - DNA, 22 bp, Artificial sequence
  SiRNA target sequence
aaaaatatctagtgcccattgt

SEQ ID NO: 245197 - DNA, 22 bp, Artificial sequence
  SiRNA target sequence
aaaatatctagtgcccattgtg

SEQ ID NO: 245198 - DNA, 22 bp, Artificial sequence
  SiRNA target sequence
aaatatctagtgcccattgtga

SEQ ID NO: 245199 - DNA, 22 bp, Artificial sequence
  SiRNA target sequence
aatatctagtgcccattgtgat

SEQ ID NO: 245200 - DNA, 22 bp, Artificial sequence
  SiRNA target sequence
atatctagtgcccattgtgatc

SEQ ID NO: 245201 - DNA, 22 bp, Artificial sequence
  SiRNA target sequence
tatctagtgcccattgtgatcc

SEQ ID NO: 245202 - DNA, 22 bp, Artificial sequence
  SiRNA target sequence
atctagtgcccattgtgatcct

SEQ ID NO: 245203 - DNA, 22 bp, Artificial sequence
  SiRNA target sequence
tctagtgcccattgtgatcctt

SEQ ID NO: 245204 - DNA, 22 bp, Artificial sequence
  SiRNA target sequence
ctagtgcccattgtgatccttt

SEQ ID NO: 245205 - DNA, 22 bp, Artificial sequence
  SiRNA target sequence
tagtgcccattgtgatcctttt

SEQ ID NO: 245206 - DNA, 22 bp, Artificial sequence
  SiRNA target sequence
agtgcccattgtgatccttttt

SEQ ID NO: 245207 - DNA, 22 bp, Artificial sequence
  SiRNA target sequence
gtgcccattgtgatcctttttg

SEQ ID NO: 245208 - DNA, 22 bp, Artificial sequence
  SiRNA target sequence
tgcccattgtgatcctttttgg

SEQ ID NO: 245209 - DNA, 22 bp, Artificial sequence
  SiRNA target sequence
gcccattgtgatcctttttgga

SEQ ID NO: 245210 - DNA, 22 bp, Artificial sequence
  SiRNA target sequence
cccattgtgatcctttttggat

SEQ ID NO: 245211 - DNA, 22 bp, Artificial sequence
  SiRNA target sequence
ccattgtgatcctttttggatt

SEQ ID NO: 245212 - DNA, 22 bp, Artificial sequence
  SiRNA target sequence
cattgtgatcctttttggattt

SEQ ID NO: 245213 - DNA, 22 bp, Artificial sequence
  SiRNA target sequence
attgtgatcctttttggatttt

SEQ ID NO: 245214 - DNA, 22 bp, Artificial sequence
  SiRNA target sequence
ttgtgatcctttttggatttta

SEQ ID NO: 245215 - DNA, 22 bp, Artificial sequence
  SiRNA target sequence
tgtgatcctttttggattttat

SEQ ID NO: 245216 - DNA, 22 bp, Artificial sequence
  SiRNA target sequence
gtgatcctttttggattttata

SEQ ID NO: 245217 - DNA, 22 bp, Artificial sequence
  SiRNA target sequence
tgatcctttttggattttatat

SEQ ID NO: 245218 - DNA, 22 bp, Artificial sequence
  SiRNA target sequence
gatcctttttggattttatatt

SEQ ID NO: 245219 - DNA, 22 bp, Artificial sequence
  SiRNA target sequence
atcctttttggattttatattc

SEQ ID NO: 245220 - DNA, 22 bp, Artificial sequence
  SiRNA target sequence
tcctttttggattttatattca

SEQ ID NO: 245221 - DNA, 22 bp, Artificial sequence
  SiRNA target sequence
cctttttggattttatattcaa

SEQ ID NO: 245222 - DNA, 22 bp, Artificial sequence
  SiRNA target sequence
ctttttggattttatattcaaa

SEQ ID NO: 245223 - DNA, 22 bp, Artificial sequence
  SiRNA target sequence
tttttggattttatattcaaat

SEQ ID NO: 245224 - DNA, 22 bp, Artificial sequence
  SiRNA target sequence
ttttggattttatattcaaatg

SEQ ID NO: 245225 - DNA, 22 bp, Artificial sequence
  SiRNA target sequence
tttggattttatattcaaatgg

SEQ ID NO: 245226 - DNA, 22 bp, Artificial sequence
  SiRNA target sequence
ttggattttatattcaaatgga

SEQ ID NO: 245227 - DNA, 22 bp, Artificial sequence
  SiRNA target sequence
tggattttatattcaaatggaa

SEQ ID NO: 245228 - DNA, 22 bp, Artificial sequence
  SiRNA target sequence
ggattttatattcaaatggaat

SEQ ID NO: 245229 - DNA, 22 bp, Artificial sequence
  SiRNA target sequence
gattttatattcaaatggaatt

SEQ ID NO: 245230 - DNA, 22 bp, Artificial sequence
  SiRNA target sequence
attttatattcaaatggaatta

SEQ ID NO: 245231 - DNA, 22 bp, Artificial sequence
  SiRNA target sequence
ttttatattcaaatggaattaa

SEQ ID NO: 245232 - DNA, 22 bp, Artificial sequence
  SiRNA target sequence
tttatattcaaatggaattaaa

SEQ ID NO: 245233 - DNA, 22 bp, Artificial sequence
  SiRNA target sequence
ttatattcaaatggaattaaaa

SEQ ID NO: 245234 - DNA, 22 bp, Artificial sequence
  SiRNA target sequence
tatattcaaatggaattaaaag

SEQ ID NO: 245235 - DNA, 22 bp, Artificial sequence
  SiRNA target sequence
atattcaaatggaattaaaaga

SEQ ID NO: 245236 - DNA, 22 bp, Artificial sequence
  SiRNA target sequence
tattcaaatggaattaaaagag

SEQ ID NO: 245237 - DNA, 22 bp, Artificial sequence
  SiRNA target sequence
attcaaatggaattaaaagaga

SEQ ID NO: 245238 - DNA, 22 bp, Artificial sequence
  SiRNA target sequence
ttcaaatggaattaaaagagaa

SEQ ID NO: 245239 - DNA, 22 bp, Artificial sequence
  SiRNA target sequence
tcaaatggaattaaaagagaac

SEQ ID NO: 245240 - DNA, 22 bp, Artificial sequence
  SiRNA target sequence
caaatggaattaaaagagaacc

SEQ ID NO: 245241 - DNA, 22 bp, Artificial sequence
  SiRNA target sequence
aaatggaattaaaagagaacca

SEQ ID NO: 245242 - DNA, 22 bp, Artificial sequence
  SiRNA target sequence
aatggaattaaaagagaaccaa

SEQ ID NO: 245243 - DNA, 22 bp, Artificial sequence
  SiRNA target sequence
atggaattaaaagagaaccaat

SEQ ID NO: 245244 - DNA, 22 bp, Artificial sequence
  SiRNA target sequence
tggaattaaaagagaaccaatt

SEQ ID NO: 245245 - DNA, 22 bp, Artificial sequence
  SiRNA target sequence
ggaattaaaagagaaccaatta

SEQ ID NO: 245246 - DNA, 22 bp, Artificial sequence
  SiRNA target sequence
gaattaaaagagaaccaattag

SEQ ID NO: 245247 - DNA, 22 bp, Artificial sequence
  SiRNA target sequence
aattaaaagagaaccaattaga

SEQ ID NO: 245248 - DNA, 22 bp, Artificial sequence
  SiRNA target sequence
attaaaagagaaccaattagaa

SEQ ID NO: 245249 - DNA, 22 bp, Artificial sequence
  SiRNA target sequence
ttaaaagagaaccaattagaaa

SEQ ID NO: 245250 - DNA, 22 bp, Artificial sequence
  SiRNA target sequence
taaaagagaaccaattagaaaa

SEQ ID NO: 245251 - DNA, 22 bp, Artificial sequence
  SiRNA target sequence
aaaagagaaccaattagaaaaa

SEQ ID NO: 245252 - DNA, 22 bp, Artificial sequence
  SiRNA target sequence
aaagagaaccaattagaaaaaa

SEQ ID NO: 245253 - DNA, 22 bp, Artificial sequence
  SiRNA target sequence
aagagaaccaattagaaaaaaa

SEQ ID NO: 245254 - DNA, 22 bp, Artificial sequence
  SiRNA target sequence
agagaaccaattagaaaaaaaa

SEQ ID NO: 245255 - DNA, 22 bp, Artificial sequence
  SiRNA target sequence
gagaaccaattagaaaaaaaat

SEQ ID NO: 245256 - DNA, 22 bp, Artificial sequence
  SiRNA target sequence
agaaccaattagaaaaaaaatg

SEQ ID NO: 245257 - DNA, 22 bp, Artificial sequence
  SiRNA target sequence
gaaccaattagaaaaaaaatgc

SEQ ID NO: 245258 - DNA, 22 bp, Artificial sequence
  SiRNA target sequence
aaccaattagaaaaaaaatgcc

SEQ ID NO: 245259 - DNA, 22 bp, Artificial sequence
  SiRNA target sequence
accaattagaaaaaaaatgcca

SEQ ID NO: 245260 - DNA, 22 bp, Artificial sequence
  SiRNA target sequence
ccaattagaaaaaaaatgccaa

SEQ ID NO: 245261 - DNA, 22 bp, Artificial sequence
  SiRNA target sequence
caattagaaaaaaaatgccaat

SEQ ID NO: 245262 - DNA, 22 bp, Artificial sequence
  SiRNA target sequence
aattagaaaaaaaatgccaata

SEQ ID NO: 245263 - DNA, 22 bp, Artificial sequence
  SiRNA target sequence
attagaaaaaaaatgccaataa

SEQ ID NO: 245264 - DNA, 22 bp, Artificial sequence
  SiRNA target sequence
ttagaaaaaaaatgccaataaa

SEQ ID NO: 245265 - DNA, 22 bp, Artificial sequence
  SiRNA target sequence
tagaaaaaaaatgccaataaaa

SEQ ID NO: 245266 - DNA, 22 bp, Artificial sequence
  SiRNA target sequence
agaaaaaaaatgccaataaaac

SEQ ID NO: 245267 - DNA, 22 bp, Artificial sequence
  SiRNA target sequence
gaaaaaaaatgccaataaaacc

SEQ ID NO: 245268 - DNA, 22 bp, Artificial sequence
  SiRNA target sequence
aaaaaaaatgccaataaaacca

SEQ ID NO: 245269 - DNA, 22 bp, Artificial sequence
  SiRNA target sequence
aaaaaaatgccaataaaaccaa

SEQ ID NO: 245270 - DNA, 22 bp, Artificial sequence
  SiRNA target sequence
aaaaaatgccaataaaaccaaa

SEQ ID NO: 245271 - DNA, 22 bp, Artificial sequence
  SiRNA target sequence
aaaaatgccaataaaaccaaaa

SEQ ID NO: 245272 - DNA, 22 bp, Artificial sequence
  SiRNA target sequence
aaaatgccaataaaaccaaaaa

SEQ ID NO: 245273 - DNA, 22 bp, Artificial sequence
  SiRNA target sequence
aaatgccaataaaaccaaaaat

SEQ ID NO: 245274 - DNA, 22 bp, Artificial sequence
  SiRNA target sequence
aatgccaataaaaccaaaaata

SEQ ID NO: 245275 - DNA, 22 bp, Artificial sequence
  SiRNA target sequence
atgccaataaaaccaaaaataa

SEQ ID NO: 245276 - DNA, 22 bp, Artificial sequence
  SiRNA target sequence
tgccaataaaaccaaaaataat

SEQ ID NO: 245277 - DNA, 22 bp, Artificial sequence
  SiRNA target sequence
gccaataaaaccaaaaataata

SEQ ID NO: 245278 - DNA, 22 bp, Artificial sequence
  SiRNA target sequence
ccaataaaaccaaaaataataa

SEQ ID NO: 245279 - DNA, 22 bp, Artificial sequence
  SiRNA target sequence
caataaaaccaaaaataataaa

SEQ ID NO: 245280 - DNA, 22 bp, Artificial sequence
  SiRNA target sequence
aataaaaccaaaaataataaaa

SEQ ID NO: 245281 - DNA, 22 bp, Artificial sequence
  SiRNA target sequence
ataaaaccaaaaataataaaat

SEQ ID NO: 245282 - DNA, 22 bp, Artificial sequence
  SiRNA target sequence
taaaaccaaaaataataaaatt

SEQ ID NO: 245283 - DNA, 22 bp, Artificial sequence
  SiRNA target sequence
aaaaccaaaaataataaaattc

SEQ ID NO: 245284 - DNA, 22 bp, Artificial sequence
  SiRNA target sequence
aaaccaaaaataataaaattca

SEQ ID NO: 245285 - DNA, 22 bp, Artificial sequence
  SiRNA target sequence
aaccaaaaataataaaattcac

SEQ ID NO: 245286 - DNA, 22 bp, Artificial sequence
  SiRNA target sequence
accaaaaataataaaattcaca

SEQ ID NO: 245287 - DNA, 22 bp, Artificial sequence
  SiRNA target sequence
ccaaaaataataaaattcacaa

SEQ ID NO: 245288 - DNA, 22 bp, Artificial sequence
  SiRNA target sequence
caaaaataataaaattcacaat

SEQ ID NO: 245289 - DNA, 22 bp, Artificial sequence
  SiRNA target sequence
aaaaataataaaattcacaata

SEQ ID NO: 245290 - DNA, 22 bp, Artificial sequence
  SiRNA target sequence
aaaataataaaattcacaatac

SEQ ID NO: 245291 - DNA, 22 bp, Artificial sequence
  SiRNA target sequence
aaataataaaattcacaatact

SEQ ID NO: 245292 - DNA, 22 bp, Artificial sequence
  SiRNA target sequence
aataataaaattcacaatacta

SEQ ID NO: 245293 - DNA, 22 bp, Artificial sequence
  SiRNA target sequence
ataataaaattcacaatactaa

SEQ ID NO: 245294 - DNA, 22 bp, Artificial sequence
  SiRNA target sequence
taataaaattcacaatactaag

SEQ ID NO: 245295 - DNA, 22 bp, Artificial sequence
  SiRNA target sequence
aataaaattcacaatactaaga

SEQ ID NO: 245296 - DNA, 22 bp, Artificial sequence
  SiRNA target sequence
ataaaattcacaatactaagaa

SEQ ID NO: 245297 - DNA, 22 bp, Artificial sequence
  SiRNA target sequence
taaaattcacaatactaagaat

SEQ ID NO: 245298 - DNA, 22 bp, Artificial sequence
  SiRNA target sequence
aaaattcacaatactaagaata

SEQ ID NO: 245299 - DNA, 22 bp, Artificial sequence
  SiRNA target sequence
aaattcacaatactaagaatag

SEQ ID NO: 245300 - DNA, 22 bp, Artificial sequence
  SiRNA target sequence
aattcacaatactaagaataga

SEQ ID NO: 245301 - DNA, 22 bp, Artificial sequence
  SiRNA target sequence
attcacaatactaagaatagag

SEQ ID NO: 245302 - DNA, 22 bp, Artificial sequence
  SiRNA target sequence
ttcacaatactaagaatagagt

SEQ ID NO: 245303 - DNA, 22 bp, Artificial sequence
  SiRNA target sequence
tcacaatactaagaatagagta

SEQ ID NO: 245304 - DNA, 22 bp, Artificial sequence
  SiRNA target sequence
cacaatactaagaatagagtac

SEQ ID NO: 245305 - DNA, 22 bp, Artificial sequence
  SiRNA target sequence
acaatactaagaatagagtaca

SEQ ID NO: 245306 - DNA, 22 bp, Artificial sequence
  SiRNA target sequence
caatactaagaatagagtacac

SEQ ID NO: 245307 - DNA, 22 bp, Artificial sequence
  SiRNA target sequence
aatactaagaatagagtacaca

SEQ ID NO: 245308 - DNA, 22 bp, Artificial sequence
  SiRNA target sequence
atactaagaatagagtacacat

SEQ ID NO: 245309 - DNA, 22 bp, Artificial sequence
  SiRNA target sequence
tactaagaatagagtacacatt

SEQ ID NO: 245310 - DNA, 22 bp, Artificial sequence
  SiRNA target sequence
actaagaatagagtacacattt

SEQ ID NO: 245311 - DNA, 22 bp, Artificial sequence
  SiRNA target sequence
ctaagaatagagtacacattta

SEQ ID NO: 245312 - DNA, 22 bp, Artificial sequence
  SiRNA target sequence
taagaatagagtacacatttaa

SEQ ID NO: 245313 - DNA, 22 bp, Artificial sequence
  SiRNA target sequence
aagaatagagtacacatttaaa

SEQ ID NO: 245314 - DNA, 22 bp, Artificial sequence
  SiRNA target sequence
agaatagagtacacatttaaag

SEQ ID NO: 245315 - DNA, 22 bp, Artificial sequence
  SiRNA target sequence
gaatagagtacacatttaaagc

SEQ ID NO: 245316 - DNA, 22 bp, Artificial sequence
  SiRNA target sequence
aatagagtacacatttaaagcc

SEQ ID NO: 245317 - DNA, 22 bp, Artificial sequence
  SiRNA target sequence
atagagtacacatttaaagcct

SEQ ID NO: 245318 - DNA, 22 bp, Artificial sequence
  SiRNA target sequence
tagagtacacatttaaagcctt

SEQ ID NO: 245319 - DNA, 22 bp, Artificial sequence
  SiRNA target sequence
agagtacacatttaaagccttt

SEQ ID NO: 245320 - DNA, 22 bp, Artificial sequence
  SiRNA target sequence
gagtacacatttaaagcctttt

SEQ ID NO: 245321 - DNA, 22 bp, Artificial sequence
  SiRNA target sequence
agtacacatttaaagccttttg

SEQ ID NO: 245322 - DNA, 22 bp, Artificial sequence
  SiRNA target sequence
gtacacatttaaagccttttgg

SEQ ID NO: 245323 - DNA, 22 bp, Artificial sequence
  SiRNA target sequence
tacacatttaaagccttttgga

SEQ ID NO: 245324 - DNA, 22 bp, Artificial sequence
  SiRNA target sequence
acacatttaaagccttttggac

SEQ ID NO: 245325 - DNA, 22 bp, Artificial sequence
  SiRNA target sequence
cacatttaaagccttttggaca

SEQ ID NO: 245326 - DNA, 22 bp, Artificial sequence
  SiRNA target sequence
acatttaaagccttttggacat

SEQ ID NO: 245327 - DNA, 22 bp, Artificial sequence
  SiRNA target sequence
catttaaagccttttggacata

SEQ ID NO: 245328 - DNA, 22 bp, Artificial sequence
  SiRNA target sequence
atttaaagccttttggacatat

SEQ ID NO: 245329 - DNA, 22 bp, Artificial sequence
  SiRNA target sequence
tttaaagccttttggacatatg

SEQ ID NO: 245330 - DNA, 22 bp, Artificial sequence
  SiRNA target sequence
ttaaagccttttggacatatga

SEQ ID NO: 245331 - DNA, 22 bp, Artificial sequence
  SiRNA target sequence
taaagccttttggacatatgac

SEQ ID NO: 245332 - DNA, 22 bp, Artificial sequence
  SiRNA target sequence
aaagccttttggacatatgaca

SEQ ID NO: 245333 - DNA, 22 bp, Artificial sequence
  SiRNA target sequence
aagccttttggacatatgacat

SEQ ID NO: 245334 - DNA, 22 bp, Artificial sequence
  SiRNA target sequence
agccttttggacatatgacatc

SEQ ID NO: 245335 - DNA, 22 bp, Artificial sequence
  SiRNA target sequence
gccttttggacatatgacatca

SEQ ID NO: 245336 - DNA, 22 bp, Artificial sequence
  SiRNA target sequence
ccttttggacatatgacatcat

SEQ ID NO: 245337 - DNA, 22 bp, Artificial sequence
  SiRNA target sequence
cttttggacatatgacatcata

SEQ ID NO: 245338 - DNA, 22 bp, Artificial sequence
  SiRNA target sequence
ttttggacatatgacatcataa

SEQ ID NO: 245339 - DNA, 22 bp, Artificial sequence
  SiRNA target sequence
tttggacatatgacatcataag

SEQ ID NO: 245340 - DNA, 22 bp, Artificial sequence
  SiRNA target sequence
ttggacatatgacatcataaga

SEQ ID NO: 245341 - DNA, 22 bp, Artificial sequence
  SiRNA target sequence
tggacatatgacatcataagac

SEQ ID NO: 245342 - DNA, 22 bp, Artificial sequence
  SiRNA target sequence
ggacatatgacatcataagaca

SEQ ID NO: 245343 - DNA, 22 bp, Artificial sequence
  SiRNA target sequence
gacatatgacatcataagacat

SEQ ID NO: 245344 - DNA, 22 bp, Artificial sequence
  SiRNA target sequence
acatatgacatcataagacata

SEQ ID NO: 245345 - DNA, 22 bp, Artificial sequence
  SiRNA target sequence
catatgacatcataagacatat

SEQ ID NO: 245346 - DNA, 22 bp, Artificial sequence
  SiRNA target sequence
atatgacatcataagacatata

SEQ ID NO: 245347 - DNA, 22 bp, Artificial sequence
  SiRNA target sequence
tatgacatcataagacatataa

SEQ ID NO: 245348 - DNA, 22 bp, Artificial sequence
  SiRNA target sequence
atgacatcataagacatataat

SEQ ID NO: 245349 - DNA, 22 bp, Artificial sequence
  SiRNA target sequence
tgacatcataagacatataatt

SEQ ID NO: 245350 - DNA, 22 bp, Artificial sequence
  SiRNA target sequence
gacatcataagacatataattg

SEQ ID NO: 245351 - DNA, 22 bp, Artificial sequence
  SiRNA target sequence
acatcataagacatataattgg

SEQ ID NO: 245352 - DNA, 22 bp, Artificial sequence
  SiRNA target sequence
catcataagacatataattggc

SEQ ID NO: 245353 - DNA, 22 bp, Artificial sequence
  SiRNA target sequence
atcataagacatataattggca

SEQ ID NO: 245354 - DNA, 22 bp, Artificial sequence
  SiRNA target sequence
tcataagacatataattggcag

SEQ ID NO: 245355 - DNA, 22 bp, Artificial sequence
  SiRNA target sequence
cataagacatataattggcagt

SEQ ID NO: 245356 - DNA, 22 bp, Artificial sequence
  SiRNA target sequence
ataagacatataattggcagtg

SEQ ID NO: 245357 - DNA, 22 bp, Artificial sequence
  SiRNA target sequence
taagacatataattggcagtga

SEQ ID NO: 245358 - DNA, 22 bp, Artificial sequence
  SiRNA target sequence
aagacatataattggcagtgaa

SEQ ID NO: 245359 - DNA, 22 bp, Artificial sequence
  SiRNA target sequence
agacatataattggcagtgaaa

SEQ ID NO: 245360 - DNA, 22 bp, Artificial sequence
  SiRNA target sequence
gacatataattggcagtgaaaa

SEQ ID NO: 245361 - DNA, 22 bp, Artificial sequence
  SiRNA target sequence
acatataattggcagtgaaaag

SEQ ID NO: 245362 - DNA, 22 bp, Artificial sequence
  SiRNA target sequence
catataattggcagtgaaaaga

SEQ ID NO: 245363 - DNA, 22 bp, Artificial sequence
  SiRNA target sequence
atataattggcagtgaaaagaa

SEQ ID NO: 245364 - DNA, 22 bp, Artificial sequence
  SiRNA target sequence
tataattggcagtgaaaagaaa

SEQ ID NO: 245365 - DNA, 22 bp, Artificial sequence
  SiRNA target sequence
ataattggcagtgaaaagaaaa

SEQ ID NO: 245366 - DNA, 22 bp, Artificial sequence
  SiRNA target sequence
taattggcagtgaaaagaaaag

SEQ ID NO: 245367 - DNA, 22 bp, Artificial sequence
  SiRNA target sequence
aattggcagtgaaaagaaaagc

SEQ ID NO: 245368 - DNA, 22 bp, Artificial sequence
  SiRNA target sequence
attggcagtgaaaagaaaagct

SEQ ID NO: 245369 - DNA, 22 bp, Artificial sequence
  SiRNA target sequence
ttggcagtgaaaagaaaagctt

SEQ ID NO: 245370 - DNA, 22 bp, Artificial sequence
  SiRNA target sequence
tggcagtgaaaagaaaagcttt

SEQ ID NO: 245371 - DNA, 22 bp, Artificial sequence
  SiRNA target sequence
ggcagtgaaaagaaaagcttta

SEQ ID NO: 245372 - DNA, 22 bp, Artificial sequence
  SiRNA target sequence
gcagtgaaaagaaaagctttat

SEQ ID NO: 245373 - DNA, 22 bp, Artificial sequence
  SiRNA target sequence
cagtgaaaagaaaagctttatg

SEQ ID NO: 245374 - DNA, 22 bp, Artificial sequence
  SiRNA target sequence
agtgaaaagaaaagctttatgt

SEQ ID NO: 245375 - DNA, 22 bp, Artificial sequence
  SiRNA target sequence
gtgaaaagaaaagctttatgta

SEQ ID NO: 245376 - DNA, 22 bp, Artificial sequence
  SiRNA target sequence
tgaaaagaaaagctttatgtag

SEQ ID NO: 245377 - DNA, 22 bp, Artificial sequence
  SiRNA target sequence
gaaaagaaaagctttatgtagt

SEQ ID NO: 245378 - DNA, 22 bp, Artificial sequence
  SiRNA target sequence
aaaagaaaagctttatgtagta

SEQ ID NO: 245379 - DNA, 22 bp, Artificial sequence
  SiRNA target sequence
aaagaaaagctttatgtagtac

SEQ ID NO: 245380 - DNA, 22 bp, Artificial sequence
  SiRNA target sequence
aagaaaagctttatgtagtaca

SEQ ID NO: 245381 - DNA, 22 bp, Artificial sequence
  SiRNA target sequence
agaaaagctttatgtagtacag

SEQ ID NO: 245382 - DNA, 22 bp, Artificial sequence
  SiRNA target sequence
gaaaagctttatgtagtacagt

SEQ ID NO: 245383 - DNA, 22 bp, Artificial sequence
  SiRNA target sequence
aaaagctttatgtagtacagtg

SEQ ID NO: 245384 - DNA, 22 bp, Artificial sequence
  SiRNA target sequence
aaagctttatgtagtacagtga

SEQ ID NO: 245385 - DNA, 22 bp, Artificial sequence
  SiRNA target sequence
aagctttatgtagtacagtgac

SEQ ID NO: 245386 - DNA, 22 bp, Artificial sequence
  SiRNA target sequence
agctttatgtagtacagtgacg

SEQ ID NO: 245387 - DNA, 22 bp, Artificial sequence
  SiRNA target sequence
gctttatgtagtacagtgacga

SEQ ID NO: 245388 - DNA, 22 bp, Artificial sequence
  SiRNA target sequence
ctttatgtagtacagtgacgaa

SEQ ID NO: 245389 - DNA, 22 bp, Artificial sequence
  SiRNA target sequence
tttatgtagtacagtgacgaag

SEQ ID NO: 245390 - DNA, 22 bp, Artificial sequence
  SiRNA target sequence
ttatgtagtacagtgacgaagg

SEQ ID NO: 245391 - DNA, 22 bp, Artificial sequence
  SiRNA target sequence
tatgtagtacagtgacgaagga

SEQ ID NO: 245392 - DNA, 22 bp, Artificial sequence
  SiRNA target sequence
atgtagtacagtgacgaaggaa

SEQ ID NO: 245393 - DNA, 22 bp, Artificial sequence
  SiRNA target sequence
tgtagtacagtgacgaaggaat

SEQ ID NO: 245394 - DNA, 22 bp, Artificial sequence
  SiRNA target sequence
gtagtacagtgacgaaggaatt

SEQ ID NO: 245395 - DNA, 22 bp, Artificial sequence
  SiRNA target sequence
tagtacagtgacgaaggaattt

SEQ ID NO: 245396 - DNA, 22 bp, Artificial sequence
  SiRNA target sequence
agtacagtgacgaaggaatttg

SEQ ID NO: 245397 - DNA, 22 bp, Artificial sequence
  SiRNA target sequence
gtacagtgacgaaggaatttgt

SEQ ID NO: 245398 - DNA, 22 bp, Artificial sequence
  SiRNA target sequence
tacagtgacgaaggaatttgtt

SEQ ID NO: 245399 - DNA, 22 bp, Artificial sequence
  SiRNA target sequence
acagtgacgaaggaatttgttt

SEQ ID NO: 245400 - DNA, 22 bp, Artificial sequence
  SiRNA target sequence
cagtgacgaaggaatttgtttt

SEQ ID NO: 245401 - DNA, 22 bp, Artificial sequence
  SiRNA target sequence
agtgacgaaggaatttgttttg

SEQ ID NO: 245402 - DNA, 22 bp, Artificial sequence
  SiRNA target sequence
gtgacgaaggaatttgttttgt

SEQ ID NO: 245403 - DNA, 22 bp, Artificial sequence
  SiRNA target sequence
tgacgaaggaatttgttttgtc

SEQ ID NO: 245404 - DNA, 22 bp, Artificial sequence
  SiRNA target sequence
gacgaaggaatttgttttgtca

SEQ ID NO: 245405 - DNA, 22 bp, Artificial sequence
  SiRNA target sequence
acgaaggaatttgttttgtcat

SEQ ID NO: 245406 - DNA, 22 bp, Artificial sequence
  SiRNA target sequence
cgaaggaatttgttttgtcata

SEQ ID NO: 245407 - DNA, 22 bp, Artificial sequence
  SiRNA target sequence
gaaggaatttgttttgtcataa

SEQ ID NO: 245408 - DNA, 22 bp, Artificial sequence
  SiRNA target sequence
aaggaatttgttttgtcataat

SEQ ID NO: 245409 - DNA, 22 bp, Artificial sequence
  SiRNA target sequence
aggaatttgttttgtcataatc

SEQ ID NO: 245410 - DNA, 22 bp, Artificial sequence
  SiRNA target sequence
ggaatttgttttgtcataatca

SEQ ID NO: 245411 - DNA, 22 bp, Artificial sequence
  SiRNA target sequence
gaatttgttttgtcataatcac

SEQ ID NO: 245412 - DNA, 22 bp, Artificial sequence
  SiRNA target sequence
aatttgttttgtcataatcacg

SEQ ID NO: 245413 - DNA, 22 bp, Artificial sequence
  SiRNA target sequence
atttgttttgtcataatcacga

SEQ ID NO: 245414 - DNA, 22 bp, Artificial sequence
  SiRNA target sequence
tttgttttgtcataatcacgat

SEQ ID NO: 245415 - DNA, 22 bp, Artificial sequence
  SiRNA target sequence
ttgttttgtcataatcacgatt

SEQ ID NO: 245416 - DNA, 22 bp, Artificial sequence
  SiRNA target sequence
tgttttgtcataatcacgattt

SEQ ID NO: 245417 - DNA, 22 bp, Artificial sequence
  SiRNA target sequence
gttttgtcataatcacgatttc

SEQ ID NO: 245418 - DNA, 22 bp, Artificial sequence
  SiRNA target sequence
ttttgtcataatcacgatttct

SEQ ID NO: 245419 - DNA, 22 bp, Artificial sequence
  SiRNA target sequence
tttgtcataatcacgatttctc

SEQ ID NO: 245420 - DNA, 22 bp, Artificial sequence
  SiRNA target sequence
ttgtcataatcacgatttctct

SEQ ID NO: 245421 - DNA, 22 bp, Artificial sequence
  SiRNA target sequence
tgtcataatcacgatttctctg

SEQ ID NO: 245422 - DNA, 22 bp, Artificial sequence
  SiRNA target sequence
gtcataatcacgatttctctgt

SEQ ID NO: 245423 - DNA, 22 bp, Artificial sequence
  SiRNA target sequence
tcataatcacgatttctctgta

SEQ ID NO: 245424 - DNA, 22 bp, Artificial sequence
  SiRNA target sequence
cataatcacgatttctctgtaa

SEQ ID NO: 245425 - DNA, 22 bp, Artificial sequence
  SiRNA target sequence
ataatcacgatttctctgtaaa

SEQ ID NO: 245426 - DNA, 22 bp, Artificial sequence
  SiRNA target sequence
taatcacgatttctctgtaaaa

SEQ ID NO: 245427 - DNA, 22 bp, Artificial sequence
  SiRNA target sequence
aatcacgatttctctgtaaaat

SEQ ID NO: 245428 - DNA, 22 bp, Artificial sequence
  SiRNA target sequence
atcacgatttctctgtaaaatt

SEQ ID NO: 245429 - DNA, 22 bp, Artificial sequence
  SiRNA target sequence
tcacgatttctctgtaaaattc

SEQ ID NO: 245430 - DNA, 22 bp, Artificial sequence
  SiRNA target sequence
cacgatttctctgtaaaattcc

SEQ ID NO: 245431 - DNA, 22 bp, Artificial sequence
  SiRNA target sequence
acgatttctctgtaaaattcca

SEQ ID NO: 245432 - DNA, 22 bp, Artificial sequence
  SiRNA target sequence
cgatttctctgtaaaattccaa

SEQ ID NO: 245433 - DNA, 22 bp, Artificial sequence
  SiRNA target sequence
gatttctctgtaaaattccaat

SEQ ID NO: 245434 - DNA, 22 bp, Artificial sequence
  SiRNA target sequence
atttctctgtaaaattccaata

SEQ ID NO: 245435 - DNA, 22 bp, Artificial sequence
  SiRNA target sequence
tttctctgtaaaattccaataa

SEQ ID NO: 245436 - DNA, 22 bp, Artificial sequence
  SiRNA target sequence
ttctctgtaaaattccaataat

SEQ ID NO: 245437 - DNA, 22 bp, Artificial sequence
  SiRNA target sequence
tctctgtaaaattccaataatg

SEQ ID NO: 245438 - DNA, 22 bp, Artificial sequence
  SiRNA target sequence
ctctgtaaaattccaataatgt

SEQ ID NO: 245439 - DNA, 22 bp, Artificial sequence
  SiRNA target sequence
tctgtaaaattccaataatgtg

SEQ ID NO: 245440 - DNA, 22 bp, Artificial sequence
  SiRNA target sequence
ctgtaaaattccaataatgtgt

SEQ ID NO: 245441 - DNA, 22 bp, Artificial sequence
  SiRNA target sequence
tgtaaaattccaataatgtgtt

SEQ ID NO: 245442 - DNA, 22 bp, Artificial sequence
  SiRNA target sequence
gtaaaattccaataatgtgtta

SEQ ID NO: 245443 - DNA, 22 bp, Artificial sequence
  SiRNA target sequence
taaaattccaataatgtgttaa

SEQ ID NO: 245444 - DNA, 22 bp, Artificial sequence
  SiRNA target sequence
aaaattccaataatgtgttaat

SEQ ID NO: 245445 - DNA, 22 bp, Artificial sequence
  SiRNA target sequence
aaattccaataatgtgttaatc

SEQ ID NO: 245446 - DNA, 22 bp, Artificial sequence
  SiRNA target sequence
aattccaataatgtgttaatca

SEQ ID NO: 245447 - DNA, 22 bp, Artificial sequence
  SiRNA target sequence
attccaataatgtgttaatcac

SEQ ID NO: 245448 - DNA, 22 bp, Artificial sequence
  SiRNA target sequence
ttccaataatgtgttaatcaca

SEQ ID NO: 245449 - DNA, 22 bp, Artificial sequence
  SiRNA target sequence
tccaataatgtgttaatcacac

SEQ ID NO: 245450 - DNA, 22 bp, Artificial sequence
  SiRNA target sequence
ccaataatgtgttaatcacaca

SEQ ID NO: 245451 - DNA, 22 bp, Artificial sequence
  SiRNA target sequence
caataatgtgttaatcacacat

SEQ ID NO: 245452 - DNA, 22 bp, Artificial sequence
  SiRNA target sequence
aataatgtgttaatcacacatg

SEQ ID NO: 245453 - DNA, 22 bp, Artificial sequence
  SiRNA target sequence
ataatgtgttaatcacacatgc

SEQ ID NO: 245454 - DNA, 22 bp, Artificial sequence
  SiRNA target sequence
taatgtgttaatcacacatgcc

SEQ ID NO: 245455 - DNA, 22 bp, Artificial sequence
  SiRNA target sequence
aatgtgttaatcacacatgcca

SEQ ID NO: 245456 - DNA, 22 bp, Artificial sequence
  SiRNA target sequence
atgtgttaatcacacatgccat

SEQ ID NO: 245457 - DNA, 22 bp, Artificial sequence
  SiRNA target sequence
tgtgttaatcacacatgccatt

SEQ ID NO: 245458 - DNA, 22 bp, Artificial sequence
  SiRNA target sequence
gtgttaatcacacatgccatta

SEQ ID NO: 245459 - DNA, 22 bp, Artificial sequence
  SiRNA target sequence
tgttaatcacacatgccattaa

SEQ ID NO: 245460 - DNA, 22 bp, Artificial sequence
  SiRNA target sequence
gttaatcacacatgccattaaa

SEQ ID NO: 245461 - DNA, 22 bp, Artificial sequence
  SiRNA target sequence
ttaatcacacatgccattaaaa

SEQ ID NO: 245462 - DNA, 22 bp, Artificial sequence
  SiRNA target sequence
taatcacacatgccattaaaaa

SEQ ID NO: 245463 - DNA, 22 bp, Artificial sequence
  SiRNA target sequence
aatcacacatgccattaaaaat

SEQ ID NO: 245464 - DNA, 22 bp, Artificial sequence
  SiRNA target sequence
atcacacatgccattaaaaatg

SEQ ID NO: 245465 - DNA, 22 bp, Artificial sequence
  SiRNA target sequence
tcacacatgccattaaaaatgt

SEQ ID NO: 245466 - DNA, 22 bp, Artificial sequence
  SiRNA target sequence
cacacatgccattaaaaatgta

SEQ ID NO: 245467 - DNA, 22 bp, Artificial sequence
  SiRNA target sequence
acacatgccattaaaaatgtaa

SEQ ID NO: 245468 - DNA, 22 bp, Artificial sequence
  SiRNA target sequence
cacatgccattaaaaatgtaag

SEQ ID NO: 245469 - DNA, 22 bp, Artificial sequence
  SiRNA target sequence
acatgccattaaaaatgtaagt

SEQ ID NO: 245470 - DNA, 22 bp, Artificial sequence
  SiRNA target sequence
catgccattaaaaatgtaagtg

SEQ ID NO: 245471 - DNA, 22 bp, Artificial sequence
  SiRNA target sequence
atgccattaaaaatgtaagtga

SEQ ID NO: 245472 - DNA, 22 bp, Artificial sequence
  SiRNA target sequence
tgccattaaaaatgtaagtgac

SEQ ID NO: 245473 - DNA, 22 bp, Artificial sequence
  SiRNA target sequence
gccattaaaaatgtaagtgaca

SEQ ID NO: 245474 - DNA, 22 bp, Artificial sequence
  SiRNA target sequence
ccattaaaaatgtaagtgacaa

SEQ ID NO: 245475 - DNA, 22 bp, Artificial sequence
  SiRNA target sequence
cattaaaaatgtaagtgacaat

SEQ ID NO: 245476 - DNA, 22 bp, Artificial sequence
  SiRNA target sequence
attaaaaatgtaagtgacaata

SEQ ID NO: 245477 - DNA, 22 bp, Artificial sequence
  SiRNA target sequence
ttaaaaatgtaagtgacaataa

SEQ ID NO: 245478 - DNA, 22 bp, Artificial sequence
  SiRNA target sequence
taaaaatgtaagtgacaataat

SEQ ID NO: 245479 - DNA, 22 bp, Artificial sequence
  SiRNA target sequence
aaaaatgtaagtgacaataata

SEQ ID NO: 245480 - DNA, 22 bp, Artificial sequence
  SiRNA target sequence
aaaatgtaagtgacaataatat

SEQ ID NO: 245481 - DNA, 22 bp, Artificial sequence
  SiRNA target sequence
aaatgtaagtgacaataatatt

SEQ ID NO: 245482 - DNA, 22 bp, Artificial sequence
  SiRNA target sequence
aatgtaagtgacaataatattt

SEQ ID NO: 245483 - DNA, 22 bp, Artificial sequence
  SiRNA target sequence
atgtaagtgacaataatatttt

SEQ ID NO: 245484 - DNA, 22 bp, Artificial sequence
  SiRNA target sequence
tgtaagtgacaataatattttt

SEQ ID NO: 245485 - DNA, 22 bp, Artificial sequence
  SiRNA target sequence
gtaagtgacaataatattttta

SEQ ID NO: 245486 - DNA, 22 bp, Artificial sequence
  SiRNA target sequence
taagtgacaataatatttttac

SEQ ID NO: 245487 - DNA, 22 bp, Artificial sequence
  SiRNA target sequence
aagtgacaataatatttttact

SEQ ID NO: 245488 - DNA, 22 bp, Artificial sequence
  SiRNA target sequence
agtgacaataatatttttactt

SEQ ID NO: 245489 - DNA, 22 bp, Artificial sequence
  SiRNA target sequence
gtgacaataatatttttacttt

SEQ ID NO: 245490 - DNA, 22 bp, Artificial sequence
  SiRNA target sequence
tgacaataatatttttactttt

SEQ ID NO: 245491 - DNA, 22 bp, Artificial sequence
  SiRNA target sequence
gacaataatatttttacttttg

SEQ ID NO: 245492 - DNA, 22 bp, Artificial sequence
  SiRNA target sequence
acaataatatttttacttttgg

SEQ ID NO: 245493 - DNA, 22 bp, Artificial sequence
  SiRNA target sequence
caataatatttttacttttggg

SEQ ID NO: 245494 - DNA, 22 bp, Artificial sequence
  SiRNA target sequence
aataatatttttacttttggga

SEQ ID NO: 245495 - DNA, 22 bp, Artificial sequence
  SiRNA target sequence
ataatatttttacttttgggaa

SEQ ID NO: 245496 - DNA, 22 bp, Artificial sequence
  SiRNA target sequence
taatatttttacttttgggaat

SEQ ID NO: 245497 - DNA, 22 bp, Artificial sequence
  SiRNA target sequence
aatatttttacttttgggaatt

SEQ ID NO: 245498 - DNA, 22 bp, Artificial sequence
  SiRNA target sequence
atatttttacttttgggaattt

SEQ ID NO: 245499 - DNA, 22 bp, Artificial sequence
  SiRNA target sequence
tatttttacttttgggaatttt

SEQ ID NO: 245500 - DNA, 22 bp, Artificial sequence
  SiRNA target sequence
atttttacttttgggaattttt

SEQ ID NO: 245501 - DNA, 22 bp, Artificial sequence
  SiRNA target sequence
tttttacttttgggaatttttt

SEQ ID NO: 245502 - DNA, 22 bp, Artificial sequence
  SiRNA target sequence
ttttacttttgggaattttttt

SEQ ID NO: 245503 - DNA, 22 bp, Artificial sequence
  SiRNA target sequence
tttacttttgggaatttttttg

SEQ ID NO: 245504 - DNA, 22 bp, Artificial sequence
  SiRNA target sequence
ttacttttgggaatttttttgt

SEQ ID NO: 245505 - DNA, 22 bp, Artificial sequence
  SiRNA target sequence
tacttttgggaatttttttgtc

SEQ ID NO: 245506 - DNA, 22 bp, Artificial sequence
  SiRNA target sequence
acttttgggaatttttttgtct

SEQ ID NO: 245507 - DNA, 22 bp, Artificial sequence
  SiRNA target sequence
cttttgggaatttttttgtctt

SEQ ID NO: 245508 - DNA, 22 bp, Artificial sequence
  SiRNA target sequence
ttttgggaatttttttgtctta

SEQ ID NO: 245509 - DNA, 22 bp, Artificial sequence
  SiRNA target sequence
tttgggaatttttttgtcttag

SEQ ID NO: 245510 - DNA, 22 bp, Artificial sequence
  SiRNA target sequence
ttgggaatttttttgtcttagt

SEQ ID NO: 245511 - DNA, 22 bp, Artificial sequence
  SiRNA target sequence
tgggaatttttttgtcttagtc

SEQ ID NO: 245512 - DNA, 22 bp, Artificial sequence
  SiRNA target sequence
gggaatttttttgtcttagtca

SEQ ID NO: 245513 - DNA, 22 bp, Artificial sequence
  SiRNA target sequence
ggaatttttttgtcttagtcat

SEQ ID NO: 245514 - DNA, 23 bp, Artificial sequence
  SiRNA target sequence
ttaattaaaatcaacatctatct

SEQ ID NO: 245515 - DNA, 23 bp, Artificial sequence
  SiRNA target sequence
taattaaaatcaacatctatctc

SEQ ID NO: 245516 - DNA, 23 bp, Artificial sequence
  SiRNA target sequence
aattaaaatcaacatctatctca

SEQ ID NO: 245517 - DNA, 23 bp, Artificial sequence
  SiRNA target sequence
attaaaatcaacatctatctcag

SEQ ID NO: 245518 - DNA, 23 bp, Artificial sequence
  SiRNA target sequence
ttaaaatcaacatctatctcaga

SEQ ID NO: 245519 - DNA, 23 bp, Artificial sequence
  SiRNA target sequence
taaaatcaacatctatctcagaa

SEQ ID NO: 245520 - DNA, 23 bp, Artificial sequence
  SiRNA target sequence
aaaatcaacatctatctcagaat

SEQ ID NO: 245521 - DNA, 23 bp, Artificial sequence
  SiRNA target sequence
aaatcaacatctatctcagaatt

SEQ ID NO: 245522 - DNA, 23 bp, Artificial sequence
  SiRNA target sequence
aatcaacatctatctcagaattt

SEQ ID NO: 245523 - DNA, 23 bp, Artificial sequence
  SiRNA target sequence
atcaacatctatctcagaatttt

SEQ ID NO: 245524 - DNA, 23 bp, Artificial sequence
  SiRNA target sequence
tcaacatctatctcagaattttg

SEQ ID NO: 245525 - DNA, 23 bp, Artificial sequence
  SiRNA target sequence
caacatctatctcagaattttgt

SEQ ID NO: 245526 - DNA, 23 bp, Artificial sequence
  SiRNA target sequence
aacatctatctcagaattttgtt

SEQ ID NO: 245527 - DNA, 23 bp, Artificial sequence
  SiRNA target sequence
acatctatctcagaattttgttc

SEQ ID NO: 245528 - DNA, 23 bp, Artificial sequence
  SiRNA target sequence
catctatctcagaattttgttca

SEQ ID NO: 245529 - DNA, 23 bp, Artificial sequence
  SiRNA target sequence
atctatctcagaattttgttcaa

SEQ ID NO: 245530 - DNA, 23 bp, Artificial sequence
  SiRNA target sequence
tctatctcagaattttgttcaat

SEQ ID NO: 245531 - DNA, 23 bp, Artificial sequence
  SiRNA target sequence
ctatctcagaattttgttcaatt

SEQ ID NO: 245532 - DNA, 23 bp, Artificial sequence
  SiRNA target sequence
tatctcagaattttgttcaattg

SEQ ID NO: 245533 - DNA, 23 bp, Artificial sequence
  SiRNA target sequence
atctcagaattttgttcaattga

SEQ ID NO: 245534 - DNA, 23 bp, Artificial sequence
  SiRNA target sequence
tctcagaattttgttcaattgat

SEQ ID NO: 245535 - DNA, 23 bp, Artificial sequence
  SiRNA target sequence
ctcagaattttgttcaattgatt

SEQ ID NO: 245536 - DNA, 23 bp, Artificial sequence
  SiRNA target sequence
tcagaattttgttcaattgattc

SEQ ID NO: 245537 - DNA, 23 bp, Artificial sequence
  SiRNA target sequence
cagaattttgttcaattgattca

SEQ ID NO: 245538 - DNA, 23 bp, Artificial sequence
  SiRNA target sequence
agaattttgttcaattgattcat

SEQ ID NO: 245539 - DNA, 23 bp, Artificial sequence
  SiRNA target sequence
gaattttgttcaattgattcatt

SEQ ID NO: 245540 - DNA, 23 bp, Artificial sequence
  SiRNA target sequence
aattttgttcaattgattcatta

SEQ ID NO: 245541 - DNA, 23 bp, Artificial sequence
  SiRNA target sequence
attttgttcaattgattcattat

SEQ ID NO: 245542 - DNA, 23 bp, Artificial sequence
  SiRNA target sequence
ttttgttcaattgattcattata

SEQ ID NO: 245543 - DNA, 23 bp, Artificial sequence
  SiRNA target sequence
tttgttcaattgattcattatat

SEQ ID NO: 245544 - DNA, 23 bp, Artificial sequence
  SiRNA target sequence
ttgttcaattgattcattatatt

SEQ ID NO: 245545 - DNA, 23 bp, Artificial sequence
  SiRNA target sequence
tgttcaattgattcattatattt

SEQ ID NO: 245546 - DNA, 23 bp, Artificial sequence
  SiRNA target sequence
gttcaattgattcattatatttt

SEQ ID NO: 245547 - DNA, 23 bp, Artificial sequence
  SiRNA target sequence
ttcaattgattcattatattttt

SEQ ID NO: 245548 - DNA, 23 bp, Artificial sequence
  SiRNA target sequence
tcaattgattcattatatttttt

SEQ ID NO: 245549 - DNA, 23 bp, Artificial sequence
  SiRNA target sequence
caattgattcattatatttttta

SEQ ID NO: 245550 - DNA, 23 bp, Artificial sequence
  SiRNA target sequence
aattgattcattatattttttac

SEQ ID NO: 245551 - DNA, 23 bp, Artificial sequence
  SiRNA target sequence
attgattcattatattttttact

SEQ ID NO: 245552 - DNA, 23 bp, Artificial sequence
  SiRNA target sequence
ttgattcattatattttttactt

SEQ ID NO: 245553 - DNA, 23 bp, Artificial sequence
  SiRNA target sequence
tgattcattatattttttactta

SEQ ID NO: 245554 - DNA, 23 bp, Artificial sequence
  SiRNA target sequence
gattcattatattttttacttaa

SEQ ID NO: 245555 - DNA, 23 bp, Artificial sequence
  SiRNA target sequence
attcattatattttttacttaaa

SEQ ID NO: 245556 - DNA, 23 bp, Artificial sequence
  SiRNA target sequence
ttcattatattttttacttaaat

SEQ ID NO: 245557 - DNA, 23 bp, Artificial sequence
  SiRNA target sequence
tcattatattttttacttaaata

SEQ ID NO: 245558 - DNA, 23 bp, Artificial sequence
  SiRNA target sequence
cattatattttttacttaaataa

SEQ ID NO: 245559 - DNA, 23 bp, Artificial sequence
  SiRNA target sequence
attatattttttacttaaataac

SEQ ID NO: 245560 - DNA, 23 bp, Artificial sequence
  SiRNA target sequence
ttatattttttacttaaataaca

SEQ ID NO: 245561 - DNA, 23 bp, Artificial sequence
  SiRNA target sequence
tatattttttacttaaataacag

SEQ ID NO: 245562 - DNA, 23 bp, Artificial sequence
  SiRNA target sequence
atattttttacttaaataacaga

SEQ ID NO: 245563 - DNA, 23 bp, Artificial sequence
  SiRNA target sequence
tattttttacttaaataacagac

SEQ ID NO: 245564 - DNA, 23 bp, Artificial sequence
  SiRNA target sequence
attttttacttaaataacagaca

SEQ ID NO: 245565 - DNA, 23 bp, Artificial sequence
  SiRNA target sequence
ttttttacttaaataacagacac

SEQ ID NO: 245566 - DNA, 23 bp, Artificial sequence
  SiRNA target sequence
tttttacttaaataacagacact

SEQ ID NO: 245567 - DNA, 23 bp, Artificial sequence
  SiRNA target sequence
ttttacttaaataacagacactc

SEQ ID NO: 245568 - DNA, 23 bp, Artificial sequence
  SiRNA target sequence
tttacttaaataacagacactcc

SEQ ID NO: 245569 - DNA, 23 bp, Artificial sequence
  SiRNA target sequence
ttacttaaataacagacactcct

SEQ ID NO: 245570 - DNA, 23 bp, Artificial sequence
  SiRNA target sequence
tacttaaataacagacactcctg

SEQ ID NO: 245571 - DNA, 23 bp, Artificial sequence
  SiRNA target sequence
acttaaataacagacactcctga

SEQ ID NO: 245572 - DNA, 23 bp, Artificial sequence
  SiRNA target sequence
cttaaataacagacactcctgat

SEQ ID NO: 245573 - DNA, 23 bp, Artificial sequence
  SiRNA target sequence
ttaaataacagacactcctgatc

SEQ ID NO: 245574 - DNA, 23 bp, Artificial sequence
  SiRNA target sequence
taaataacagacactcctgatcc

SEQ ID NO: 245575 - DNA, 23 bp, Artificial sequence
  SiRNA target sequence
aaataacagacactcctgatcca

SEQ ID NO: 245576 - DNA, 23 bp, Artificial sequence
  SiRNA target sequence
aataacagacactcctgatccac

SEQ ID NO: 245577 - DNA, 23 bp, Artificial sequence
  SiRNA target sequence
ataacagacactcctgatccaca

SEQ ID NO: 245578 - DNA, 23 bp, Artificial sequence
  SiRNA target sequence
taacagacactcctgatccacaa

SEQ ID NO: 245579 - DNA, 23 bp, Artificial sequence
  SiRNA target sequence
aacagacactcctgatccacaaa

SEQ ID NO: 245580 - DNA, 23 bp, Artificial sequence
  SiRNA target sequence
acagacactcctgatccacaaaa

SEQ ID NO: 245581 - DNA, 23 bp, Artificial sequence
  SiRNA target sequence
cagacactcctgatccacaaaaa

SEQ ID NO: 245582 - DNA, 23 bp, Artificial sequence
  SiRNA target sequence
agacactcctgatccacaaaaaa

SEQ ID NO: 245583 - DNA, 23 bp, Artificial sequence
  SiRNA target sequence
gacactcctgatccacaaaaaat

SEQ ID NO: 245584 - DNA, 23 bp, Artificial sequence
  SiRNA target sequence
acactcctgatccacaaaaaatt

SEQ ID NO: 245585 - DNA, 23 bp, Artificial sequence
  SiRNA target sequence
cactcctgatccacaaaaaattt

SEQ ID NO: 245586 - DNA, 23 bp, Artificial sequence
  SiRNA target sequence
actcctgatccacaaaaaatttg

SEQ ID NO: 245587 - DNA, 23 bp, Artificial sequence
  SiRNA target sequence
ctcctgatccacaaaaaatttgc

SEQ ID NO: 245588 - DNA, 23 bp, Artificial sequence
  SiRNA target sequence
tcctgatccacaaaaaatttgca

SEQ ID NO: 245589 - DNA, 23 bp, Artificial sequence
  SiRNA target sequence
cctgatccacaaaaaatttgcaa

SEQ ID NO: 245590 - DNA, 23 bp, Artificial sequence
  SiRNA target sequence
ctgatccacaaaaaatttgcaaa

SEQ ID NO: 245591 - DNA, 23 bp, Artificial sequence
  SiRNA target sequence
tgatccacaaaaaatttgcaaat

SEQ ID NO: 245592 - DNA, 23 bp, Artificial sequence
  SiRNA target sequence
gatccacaaaaaatttgcaaata

SEQ ID NO: 245593 - DNA, 23 bp, Artificial sequence
  SiRNA target sequence
atccacaaaaaatttgcaaatat

SEQ ID NO: 245594 - DNA, 23 bp, Artificial sequence
  SiRNA target sequence
tccacaaaaaatttgcaaatatt

SEQ ID NO: 245595 - DNA, 23 bp, Artificial sequence
  SiRNA target sequence
ccacaaaaaatttgcaaatatta

SEQ ID NO: 245596 - DNA, 23 bp, Artificial sequence
  SiRNA target sequence
cacaaaaaatttgcaaatattaa

SEQ ID NO: 245597 - DNA, 23 bp, Artificial sequence
  SiRNA target sequence
acaaaaaatttgcaaatattaaa

SEQ ID NO: 245598 - DNA, 23 bp, Artificial sequence
  SiRNA target sequence
caaaaaatttgcaaatattaaaa

SEQ ID NO: 245599 - DNA, 23 bp, Artificial sequence
  SiRNA target sequence
aaaaaatttgcaaatattaaaaa

SEQ ID NO: 245600 - DNA, 23 bp, Artificial sequence
  SiRNA target sequence
aaaaatttgcaaatattaaaaat

SEQ ID NO: 245601 - DNA, 23 bp, Artificial sequence
  SiRNA target sequence
aaaatttgcaaatattaaaaata

SEQ ID NO: 245602 - DNA, 23 bp, Artificial sequence
  SiRNA target sequence
aaatttgcaaatattaaaaatat

SEQ ID NO: 245603 - DNA, 23 bp, Artificial sequence
  SiRNA target sequence
aatttgcaaatattaaaaatata

SEQ ID NO: 245604 - DNA, 23 bp, Artificial sequence
  SiRNA target sequence
atttgcaaatattaaaaatataa

SEQ ID NO: 245605 - DNA, 23 bp, Artificial sequence
  SiRNA target sequence
tttgcaaatattaaaaatataaa

SEQ ID NO: 245606 - DNA, 23 bp, Artificial sequence
  SiRNA target sequence
ttgcaaatattaaaaatataaaa

SEQ ID NO: 245607 - DNA, 23 bp, Artificial sequence
  SiRNA target sequence
tgcaaatattaaaaatataaaag

SEQ ID NO: 245608 - DNA, 23 bp, Artificial sequence
  SiRNA target sequence
gcaaatattaaaaatataaaaga

SEQ ID NO: 245609 - DNA, 23 bp, Artificial sequence
  SiRNA target sequence
caaatattaaaaatataaaagac

SEQ ID NO: 245610 - DNA, 23 bp, Artificial sequence
  SiRNA target sequence
aaatattaaaaatataaaagaca

SEQ ID NO: 245611 - DNA, 23 bp, Artificial sequence
  SiRNA target sequence
aatattaaaaatataaaagacac

SEQ ID NO: 245612 - DNA, 23 bp, Artificial sequence
  SiRNA target sequence
atattaaaaatataaaagacacg

SEQ ID NO: 245613 - DNA, 23 bp, Artificial sequence
  SiRNA target sequence
tattaaaaatataaaagacacgt

SEQ ID NO: 245614 - DNA, 23 bp, Artificial sequence
  SiRNA target sequence
attaaaaatataaaagacacgta

SEQ ID NO: 245615 - DNA, 23 bp, Artificial sequence
  SiRNA target sequence
ttaaaaatataaaagacacgtat

SEQ ID NO: 245616 - DNA, 23 bp, Artificial sequence
  SiRNA target sequence
taaaaatataaaagacacgtatg

SEQ ID NO: 245617 - DNA, 23 bp, Artificial sequence
  SiRNA target sequence
aaaaatataaaagacacgtatga

SEQ ID NO: 245618 - DNA, 23 bp, Artificial sequence
  SiRNA target sequence
aaaatataaaagacacgtatgat

SEQ ID NO: 245619 - DNA, 23 bp, Artificial sequence
  SiRNA target sequence
aaatataaaagacacgtatgata

SEQ ID NO: 245620 - DNA, 23 bp, Artificial sequence
  SiRNA target sequence
aatataaaagacacgtatgatac

SEQ ID NO: 245621 - DNA, 23 bp, Artificial sequence
  SiRNA target sequence
atataaaagacacgtatgatact

SEQ ID NO: 245622 - DNA, 23 bp, Artificial sequence
  SiRNA target sequence
tataaaagacacgtatgatactt

SEQ ID NO: 245623 - DNA, 23 bp, Artificial sequence
  SiRNA target sequence
ataaaagacacgtatgatacttg

SEQ ID NO: 245624 - DNA, 23 bp, Artificial sequence
  SiRNA target sequence
taaaagacacgtatgatacttgt

SEQ ID NO: 245625 - DNA, 23 bp, Artificial sequence
  SiRNA target sequence
aaaagacacgtatgatacttgtc

SEQ ID NO: 245626 - DNA, 23 bp, Artificial sequence
  SiRNA target sequence
aaagacacgtatgatacttgtct

SEQ ID NO: 245627 - DNA, 23 bp, Artificial sequence
  SiRNA target sequence
aagacacgtatgatacttgtcta

SEQ ID NO: 245628 - DNA, 23 bp, Artificial sequence
  SiRNA target sequence
agacacgtatgatacttgtctaa

SEQ ID NO: 245629 - DNA, 23 bp, Artificial sequence
  SiRNA target sequence
gacacgtatgatacttgtctaat

SEQ ID NO: 245630 - DNA, 23 bp, Artificial sequence
  SiRNA target sequence
acacgtatgatacttgtctaata

SEQ ID NO: 245631 - DNA, 23 bp, Artificial sequence
  SiRNA target sequence
cacgtatgatacttgtctaatat

SEQ ID NO: 245632 - DNA, 23 bp, Artificial sequence
  SiRNA target sequence
acgtatgatacttgtctaatatc

SEQ ID NO: 245633 - DNA, 23 bp, Artificial sequence
  SiRNA target sequence
cgtatgatacttgtctaatatct

SEQ ID NO: 245634 - DNA, 23 bp, Artificial sequence
  SiRNA target sequence
gtatgatacttgtctaatatctg

SEQ ID NO: 245635 - DNA, 23 bp, Artificial sequence
  SiRNA target sequence
tatgatacttgtctaatatctgg

SEQ ID NO: 245636 - DNA, 23 bp, Artificial sequence
  SiRNA target sequence
atgatacttgtctaatatctgga

SEQ ID NO: 245637 - DNA, 23 bp, Artificial sequence
  SiRNA target sequence
tgatacttgtctaatatctggaa

SEQ ID NO: 245638 - DNA, 23 bp, Artificial sequence
  SiRNA target sequence
gatacttgtctaatatctggaat

SEQ ID NO: 245639 - DNA, 23 bp, Artificial sequence
  SiRNA target sequence
atacttgtctaatatctggaatt

SEQ ID NO: 245640 - DNA, 23 bp, Artificial sequence
  SiRNA target sequence
tacttgtctaatatctggaattt

SEQ ID NO: 245641 - DNA, 23 bp, Artificial sequence
  SiRNA target sequence
acttgtctaatatctggaatttc

SEQ ID NO: 245642 - DNA, 23 bp, Artificial sequence
  SiRNA target sequence
cttgtctaatatctggaatttct

SEQ ID NO: 245643 - DNA, 23 bp, Artificial sequence
  SiRNA target sequence
ttgtctaatatctggaatttcta

SEQ ID NO: 245644 - DNA, 23 bp, Artificial sequence
  SiRNA target sequence
tgtctaatatctggaatttctat

SEQ ID NO: 245645 - DNA, 23 bp, Artificial sequence
  SiRNA target sequence
gtctaatatctggaatttctata

SEQ ID NO: 245646 - DNA, 23 bp, Artificial sequence
  SiRNA target sequence
tctaatatctggaatttctataa

SEQ ID NO: 245647 - DNA, 23 bp, Artificial sequence
  SiRNA target sequence
ctaatatctggaatttctataaa

SEQ ID NO: 245648 - DNA, 23 bp, Artificial sequence
  SiRNA target sequence
taatatctggaatttctataaac

SEQ ID NO: 245649 - DNA, 23 bp, Artificial sequence
  SiRNA target sequence
aatatctggaatttctataaacg

SEQ ID NO: 245650 - DNA, 23 bp, Artificial sequence
  SiRNA target sequence
atatctggaatttctataaacgt

SEQ ID NO: 245651 - DNA, 23 bp, Artificial sequence
  SiRNA target sequence
tatctggaatttctataaacgtc

SEQ ID NO: 245652 - DNA, 23 bp, Artificial sequence
  SiRNA target sequence
atctggaatttctataaacgtca

SEQ ID NO: 245653 - DNA, 23 bp, Artificial sequence
  SiRNA target sequence
tctggaatttctataaacgtcaa

SEQ ID NO: 245654 - DNA, 23 bp, Artificial sequence
  SiRNA target sequence
ctggaatttctataaacgtcaaa

SEQ ID NO: 245655 - DNA, 23 bp, Artificial sequence
  SiRNA target sequence
tggaatttctataaacgtcaaaa

SEQ ID NO: 245656 - DNA, 23 bp, Artificial sequence
  SiRNA target sequence
ggaatttctataaacgtcaaaaa

SEQ ID NO: 245657 - DNA, 23 bp, Artificial sequence
  SiRNA target sequence
gaatttctataaacgtcaaaaaa

SEQ ID NO: 245658 - DNA, 23 bp, Artificial sequence
  SiRNA target sequence
aatttctataaacgtcaaaaaag

SEQ ID NO: 245659 - DNA, 23 bp, Artificial sequence
  SiRNA target sequence
atttctataaacgtcaaaaaagt

SEQ ID NO: 245660 - DNA, 23 bp, Artificial sequence
  SiRNA target sequence
tttctataaacgtcaaaaaagtt

SEQ ID NO: 245661 - DNA, 23 bp, Artificial sequence
  SiRNA target sequence
ttctataaacgtcaaaaaagttc

SEQ ID NO: 245662 - DNA, 23 bp, Artificial sequence
  SiRNA target sequence
tctataaacgtcaaaaaagttcc

SEQ ID NO: 245663 - DNA, 23 bp, Artificial sequence
  SiRNA target sequence
ctataaacgtcaaaaaagttcca

SEQ ID NO: 245664 - DNA, 23 bp, Artificial sequence
  SiRNA target sequence
tataaacgtcaaaaaagttccat

SEQ ID NO: 245665 - DNA, 23 bp, Artificial sequence
  SiRNA target sequence
ataaacgtcaaaaaagttccata

SEQ ID NO: 245666 - DNA, 23 bp, Artificial sequence
  SiRNA target sequence
taaacgtcaaaaaagttccatat

SEQ ID NO: 245667 - DNA, 23 bp, Artificial sequence
  SiRNA target sequence
aaacgtcaaaaaagttccatata

SEQ ID NO: 245668 - DNA, 23 bp, Artificial sequence
  SiRNA target sequence
aacgtcaaaaaagttccatataa

SEQ ID NO: 245669 - DNA, 23 bp, Artificial sequence
  SiRNA target sequence
acgtcaaaaaagttccatataaa

SEQ ID NO: 245670 - DNA, 23 bp, Artificial sequence
  SiRNA target sequence
cgtcaaaaaagttccatataaag

SEQ ID NO: 245671 - DNA, 23 bp, Artificial sequence
  SiRNA target sequence
gtcaaaaaagttccatataaaga

SEQ ID NO: 245672 - DNA, 23 bp, Artificial sequence
  SiRNA target sequence
tcaaaaaagttccatataaagag

SEQ ID NO: 245673 - DNA, 23 bp, Artificial sequence
  SiRNA target sequence
caaaaaagttccatataaagaga

SEQ ID NO: 245674 - DNA, 23 bp, Artificial sequence
  SiRNA target sequence
aaaaaagttccatataaagagat

SEQ ID NO: 245675 - DNA, 23 bp, Artificial sequence
  SiRNA target sequence
aaaaagttccatataaagagata

SEQ ID NO: 245676 - DNA, 23 bp, Artificial sequence
  SiRNA target sequence
aaaagttccatataaagagataa

SEQ ID NO: 245677 - DNA, 23 bp, Artificial sequence
  SiRNA target sequence
aaagttccatataaagagataat

SEQ ID NO: 245678 - DNA, 23 bp, Artificial sequence
  SiRNA target sequence
aagttccatataaagagataata

SEQ ID NO: 245679 - DNA, 23 bp, Artificial sequence
  SiRNA target sequence
agttccatataaagagataatag

SEQ ID NO: 245680 - DNA, 23 bp, Artificial sequence
  SiRNA target sequence
gttccatataaagagataataga

SEQ ID NO: 245681 - DNA, 23 bp, Artificial sequence
  SiRNA target sequence
ttccatataaagagataatagat

SEQ ID NO: 245682 - DNA, 23 bp, Artificial sequence
  SiRNA target sequence
tccatataaagagataatagatt

SEQ ID NO: 245683 - DNA, 23 bp, Artificial sequence
  SiRNA target sequence
ccatataaagagataatagattt

SEQ ID NO: 245684 - DNA, 23 bp, Artificial sequence
  SiRNA target sequence
catataaagagataatagattta

SEQ ID NO: 245685 - DNA, 23 bp, Artificial sequence
  SiRNA target sequence
atataaagagataatagatttac

SEQ ID NO: 245686 - DNA, 23 bp, Artificial sequence
  SiRNA target sequence
tataaagagataatagatttacc

SEQ ID NO: 245687 - DNA, 23 bp, Artificial sequence
  SiRNA target sequence
ataaagagataatagatttacca

SEQ ID NO: 245688 - DNA, 23 bp, Artificial sequence
  SiRNA target sequence
taaagagataatagatttaccaa

SEQ ID NO: 245689 - DNA, 23 bp, Artificial sequence
  SiRNA target sequence
aaagagataatagatttaccaat

SEQ ID NO: 245690 - DNA, 23 bp, Artificial sequence
  SiRNA target sequence
aagagataatagatttaccaatt

SEQ ID NO: 245691 - DNA, 23 bp, Artificial sequence
  SiRNA target sequence
agagataatagatttaccaattt

SEQ ID NO: 245692 - DNA, 23 bp, Artificial sequence
  SiRNA target sequence
gagataatagatttaccaatttt

SEQ ID NO: 245693 - DNA, 23 bp, Artificial sequence
  SiRNA target sequence
agataatagatttaccaattttg

SEQ ID NO: 245694 - DNA, 23 bp, Artificial sequence
  SiRNA target sequence
gataatagatttaccaattttga

SEQ ID NO: 245695 - DNA, 23 bp, Artificial sequence
  SiRNA target sequence
ataatagatttaccaattttgat

SEQ ID NO: 245696 - DNA, 23 bp, Artificial sequence
  SiRNA target sequence
taatagatttaccaattttgata

SEQ ID NO: 245697 - DNA, 23 bp, Artificial sequence
  SiRNA target sequence
aatagatttaccaattttgatac

SEQ ID NO: 245698 - DNA, 23 bp, Artificial sequence
  SiRNA target sequence
atagatttaccaattttgataca

SEQ ID NO: 245699 - DNA, 23 bp, Artificial sequence
  SiRNA target sequence
tagatttaccaattttgatacat

SEQ ID NO: 245700 - DNA, 23 bp, Artificial sequence
  SiRNA target sequence
agatttaccaattttgatacata

SEQ ID NO: 245701 - DNA, 23 bp, Artificial sequence
  SiRNA target sequence
gatttaccaattttgatacatac

SEQ ID NO: 245702 - DNA, 23 bp, Artificial sequence
  SiRNA target sequence
atttaccaattttgatacataca

SEQ ID NO: 245703 - DNA, 23 bp, Artificial sequence
  SiRNA target sequence
tttaccaattttgatacatacac

SEQ ID NO: 245704 - DNA, 23 bp, Artificial sequence
  SiRNA target sequence
ttaccaattttgatacatacacc

SEQ ID NO: 245705 - DNA, 23 bp, Artificial sequence
  SiRNA target sequence
taccaattttgatacatacacca

SEQ ID NO: 245706 - DNA, 23 bp, Artificial sequence
  SiRNA target sequence
accaattttgatacatacaccat

SEQ ID NO: 245707 - DNA, 23 bp, Artificial sequence
  SiRNA target sequence
ccaattttgatacatacaccatc

SEQ ID NO: 245708 - DNA, 23 bp, Artificial sequence
  SiRNA target sequence
caattttgatacatacaccatca

SEQ ID NO: 245709 - DNA, 23 bp, Artificial sequence
  SiRNA target sequence
aattttgatacatacaccatcat

SEQ ID NO: 245710 - DNA, 23 bp, Artificial sequence
  SiRNA target sequence
attttgatacatacaccatcata

SEQ ID NO: 245711 - DNA, 23 bp, Artificial sequence
  SiRNA target sequence
ttttgatacatacaccatcataa

SEQ ID NO: 245712 - DNA, 23 bp, Artificial sequence
  SiRNA target sequence
tttgatacatacaccatcataaa

SEQ ID NO: 245713 - DNA, 23 bp, Artificial sequence
  SiRNA target sequence
ttgatacatacaccatcataaaa

SEQ ID NO: 245714 - DNA, 23 bp, Artificial sequence
  SiRNA target sequence
tgatacatacaccatcataaaaa

SEQ ID NO: 245715 - DNA, 23 bp, Artificial sequence
  SiRNA target sequence
gatacatacaccatcataaaaac

SEQ ID NO: 245716 - DNA, 23 bp, Artificial sequence
  SiRNA target sequence
atacatacaccatcataaaaact

SEQ ID NO: 245717 - DNA, 23 bp, Artificial sequence
  SiRNA target sequence
tacatacaccatcataaaaactt

SEQ ID NO: 245718 - DNA, 23 bp, Artificial sequence
  SiRNA target sequence
acatacaccatcataaaaacttt

SEQ ID NO: 245719 - DNA, 23 bp, Artificial sequence
  SiRNA target sequence
catacaccatcataaaaactttt

SEQ ID NO: 245720 - DNA, 23 bp, Artificial sequence
  SiRNA target sequence
atacaccatcataaaaactttta

SEQ ID NO: 245721 - DNA, 23 bp, Artificial sequence
  SiRNA target sequence
tacaccatcataaaaacttttaa

SEQ ID NO: 245722 - DNA, 23 bp, Artificial sequence
  SiRNA target sequence
acaccatcataaaaacttttaaa

SEQ ID NO: 245723 - DNA, 23 bp, Artificial sequence
  SiRNA target sequence
caccatcataaaaacttttaaat

SEQ ID NO: 245724 - DNA, 23 bp, Artificial sequence
  SiRNA target sequence
accatcataaaaacttttaaatt

SEQ ID NO: 245725 - DNA, 23 bp, Artificial sequence
  SiRNA target sequence
ccatcataaaaacttttaaattt

SEQ ID NO: 245726 - DNA, 23 bp, Artificial sequence
  SiRNA target sequence
catcataaaaacttttaaattta

SEQ ID NO: 245727 - DNA, 23 bp, Artificial sequence
  SiRNA target sequence
atcataaaaacttttaaatttat

SEQ ID NO: 245728 - DNA, 23 bp, Artificial sequence
  SiRNA target sequence
tcataaaaacttttaaatttata

SEQ ID NO: 245729 - DNA, 23 bp, Artificial sequence
  SiRNA target sequence
cataaaaacttttaaatttatac

SEQ ID NO: 245730 - DNA, 23 bp, Artificial sequence
  SiRNA target sequence
ataaaaacttttaaatttatacc

SEQ ID NO: 245731 - DNA, 23 bp, Artificial sequence
  SiRNA target sequence
taaaaacttttaaatttatacct

SEQ ID NO: 245732 - DNA, 23 bp, Artificial sequence
  SiRNA target sequence
aaaaacttttaaatttatacctg

SEQ ID NO: 245733 - DNA, 23 bp, Artificial sequence
  SiRNA target sequence
aaaacttttaaatttatacctgt

SEQ ID NO: 245734 - DNA, 23 bp, Artificial sequence
  SiRNA target sequence
aaacttttaaatttatacctgta

SEQ ID NO: 245735 - DNA, 23 bp, Artificial sequence
  SiRNA target sequence
aacttttaaatttatacctgtat

SEQ ID NO: 245736 - DNA, 23 bp, Artificial sequence
  SiRNA target sequence
acttttaaatttatacctgtatt

SEQ ID NO: 245737 - DNA, 23 bp, Artificial sequence
  SiRNA target sequence
cttttaaatttatacctgtattt

SEQ ID NO: 245738 - DNA, 23 bp, Artificial sequence
  SiRNA target sequence
ttttaaatttatacctgtattta

SEQ ID NO: 245739 - DNA, 23 bp, Artificial sequence
  SiRNA target sequence
tttaaatttatacctgtatttaa

SEQ ID NO: 245740 - DNA, 23 bp, Artificial sequence
  SiRNA target sequence
ttaaatttatacctgtatttaac

SEQ ID NO: 245741 - DNA, 23 bp, Artificial sequence
  SiRNA target sequence
taaatttatacctgtatttaaca

SEQ ID NO: 245742 - DNA, 23 bp, Artificial sequence
  SiRNA target sequence
aaatttatacctgtatttaacag

SEQ ID NO: 245743 - DNA, 23 bp, Artificial sequence
  SiRNA target sequence
aatttatacctgtatttaacagg

SEQ ID NO: 245744 - DNA, 23 bp, Artificial sequence
  SiRNA target sequence
atttatacctgtatttaacaggc

SEQ ID NO: 245745 - DNA, 23 bp, Artificial sequence
  SiRNA target sequence
tttatacctgtatttaacaggca

SEQ ID NO: 245746 - DNA, 23 bp, Artificial sequence
  SiRNA target sequence
ttatacctgtatttaacaggcac

SEQ ID NO: 245747 - DNA, 23 bp, Artificial sequence
  SiRNA target sequence
tatacctgtatttaacaggcacc

SEQ ID NO: 245748 - DNA, 23 bp, Artificial sequence
  SiRNA target sequence
atacctgtatttaacaggcaccc

SEQ ID NO: 245749 - DNA, 23 bp, Artificial sequence
  SiRNA target sequence
tacctgtatttaacaggcaccct

SEQ ID NO: 245750 - DNA, 23 bp, Artificial sequence
  SiRNA target sequence
acctgtatttaacaggcaccctc

SEQ ID NO: 245751 - DNA, 23 bp, Artificial sequence
  SiRNA target sequence
cctgtatttaacaggcaccctca

SEQ ID NO: 245752 - DNA, 23 bp, Artificial sequence
  SiRNA target sequence
ctgtatttaacaggcaccctcat

SEQ ID NO: 245753 - DNA, 23 bp, Artificial sequence
  SiRNA target sequence
tgtatttaacaggcaccctcata

SEQ ID NO: 245754 - DNA, 23 bp, Artificial sequence
  SiRNA target sequence
gtatttaacaggcaccctcatag

SEQ ID NO: 245755 - DNA, 23 bp, Artificial sequence
  SiRNA target sequence
tatttaacaggcaccctcataga

SEQ ID NO: 245756 - DNA, 23 bp, Artificial sequence
  SiRNA target sequence
atttaacaggcaccctcatagaa

SEQ ID NO: 245757 - DNA, 23 bp, Artificial sequence
  SiRNA target sequence
tttaacaggcaccctcatagaaa

SEQ ID NO: 245758 - DNA, 23 bp, Artificial sequence
  SiRNA target sequence
ttaacaggcaccctcatagaaag

SEQ ID NO: 245759 - DNA, 23 bp, Artificial sequence
  SiRNA target sequence
taacaggcaccctcatagaaagc

SEQ ID NO: 245760 - DNA, 23 bp, Artificial sequence
  SiRNA target sequence
aacaggcaccctcatagaaagca

SEQ ID NO: 245761 - DNA, 23 bp, Artificial sequence
  SiRNA target sequence
acaggcaccctcatagaaagcat

SEQ ID NO: 245762 - DNA, 23 bp, Artificial sequence
  SiRNA target sequence
caggcaccctcatagaaagcatt

SEQ ID NO: 245763 - DNA, 23 bp, Artificial sequence
  SiRNA target sequence
aggcaccctcatagaaagcattt

SEQ ID NO: 245764 - DNA, 23 bp, Artificial sequence
  SiRNA target sequence
ggcaccctcatagaaagcatttc

SEQ ID NO: 245765 - DNA, 23 bp, Artificial sequence
  SiRNA target sequence
gcaccctcatagaaagcatttct

SEQ ID NO: 245766 - DNA, 23 bp, Artificial sequence
  SiRNA target sequence
caccctcatagaaagcatttctt

SEQ ID NO: 245767 - DNA, 23 bp, Artificial sequence
  SiRNA target sequence
accctcatagaaagcatttcttt

SEQ ID NO: 245768 - DNA, 23 bp, Artificial sequence
  SiRNA target sequence
ccctcatagaaagcatttctttt

SEQ ID NO: 245769 - DNA, 23 bp, Artificial sequence
  SiRNA target sequence
cctcatagaaagcatttcttttg

SEQ ID NO: 245770 - DNA, 23 bp, Artificial sequence
  SiRNA target sequence
ctcatagaaagcatttcttttgc

SEQ ID NO: 245771 - DNA, 23 bp, Artificial sequence
  SiRNA target sequence
tcatagaaagcatttcttttgct

SEQ ID NO: 245772 - DNA, 23 bp, Artificial sequence
  SiRNA target sequence
catagaaagcatttcttttgcta

SEQ ID NO: 245773 - DNA, 23 bp, Artificial sequence
  SiRNA target sequence
atagaaagcatttcttttgctaa

SEQ ID NO: 245774 - DNA, 23 bp, Artificial sequence
  SiRNA target sequence
tagaaagcatttcttttgctaaa

SEQ ID NO: 245775 - DNA, 23 bp, Artificial sequence
  SiRNA target sequence
agaaagcatttcttttgctaaat

SEQ ID NO: 245776 - DNA, 23 bp, Artificial sequence
  SiRNA target sequence
gaaagcatttcttttgctaaatc

SEQ ID NO: 245777 - DNA, 23 bp, Artificial sequence
  SiRNA target sequence
aaagcatttcttttgctaaatca

SEQ ID NO: 245778 - DNA, 23 bp, Artificial sequence
  SiRNA target sequence
aagcatttcttttgctaaatcaa

SEQ ID NO: 245779 - DNA, 23 bp, Artificial sequence
  SiRNA target sequence
agcatttcttttgctaaatcaaa

SEQ ID NO: 245780 - DNA, 23 bp, Artificial sequence
  SiRNA target sequence
gcatttcttttgctaaatcaaat

SEQ ID NO: 245781 - DNA, 23 bp, Artificial sequence
  SiRNA target sequence
catttcttttgctaaatcaaata

SEQ ID NO: 245782 - DNA, 23 bp, Artificial sequence
  SiRNA target sequence
atttcttttgctaaatcaaataa

SEQ ID NO: 245783 - DNA, 23 bp, Artificial sequence
  SiRNA target sequence
tttcttttgctaaatcaaataaa

SEQ ID NO: 245784 - DNA, 23 bp, Artificial sequence
  SiRNA target sequence
ttcttttgctaaatcaaataaaa

SEQ ID NO: 245785 - DNA, 23 bp, Artificial sequence
  SiRNA target sequence
tcttttgctaaatcaaataaaac

SEQ ID NO: 245786 - DNA, 23 bp, Artificial sequence
  SiRNA target sequence
cttttgctaaatcaaataaaaca

SEQ ID NO: 245787 - DNA, 23 bp, Artificial sequence
  SiRNA target sequence
ttttgctaaatcaaataaaacat

SEQ ID NO: 245788 - DNA, 23 bp, Artificial sequence
  SiRNA target sequence
tttgctaaatcaaataaaacata

SEQ ID NO: 245789 - DNA, 23 bp, Artificial sequence
  SiRNA target sequence
ttgctaaatcaaataaaacatat

SEQ ID NO: 245790 - DNA, 23 bp, Artificial sequence
  SiRNA target sequence
tgctaaatcaaataaaacatatt

SEQ ID NO: 245791 - DNA, 23 bp, Artificial sequence
  SiRNA target sequence
gctaaatcaaataaaacatattt

SEQ ID NO: 245792 - DNA, 23 bp, Artificial sequence
  SiRNA target sequence
ctaaatcaaataaaacatatttg

SEQ ID NO: 245793 - DNA, 23 bp, Artificial sequence
  SiRNA target sequence
taaatcaaataaaacatatttgg

SEQ ID NO: 245794 - DNA, 23 bp, Artificial sequence
  SiRNA target sequence
aaatcaaataaaacatatttggt

SEQ ID NO: 245795 - DNA, 23 bp, Artificial sequence
  SiRNA target sequence
aatcaaataaaacatatttggta

SEQ ID NO: 245796 - DNA, 23 bp, Artificial sequence
  SiRNA target sequence
atcaaataaaacatatttggtaa

SEQ ID NO: 245797 - DNA, 23 bp, Artificial sequence
  SiRNA target sequence
tcaaataaaacatatttggtaat

SEQ ID NO: 245798 - DNA, 23 bp, Artificial sequence
  SiRNA target sequence
caaataaaacatatttggtaatt

SEQ ID NO: 245799 - DNA, 23 bp, Artificial sequence
  SiRNA target sequence
aaataaaacatatttggtaattt

SEQ ID NO: 245800 - DNA, 23 bp, Artificial sequence
  SiRNA target sequence
aataaaacatatttggtaatttt

SEQ ID NO: 245801 - DNA, 23 bp, Artificial sequence
  SiRNA target sequence
ataaaacatatttggtaatttta

SEQ ID NO: 245802 - DNA, 23 bp, Artificial sequence
  SiRNA target sequence
taaaacatatttggtaattttag

SEQ ID NO: 245803 - DNA, 23 bp, Artificial sequence
  SiRNA target sequence
aaaacatatttggtaattttaga

SEQ ID NO: 245804 - DNA, 23 bp, Artificial sequence
  SiRNA target sequence
aaacatatttggtaattttagaa

SEQ ID NO: 245805 - DNA, 23 bp, Artificial sequence
  SiRNA target sequence
aacatatttggtaattttagaaa

SEQ ID NO: 245806 - DNA, 23 bp, Artificial sequence
  SiRNA target sequence
acatatttggtaattttagaaaa

SEQ ID NO: 245807 - DNA, 23 bp, Artificial sequence
  SiRNA target sequence
catatttggtaattttagaaaat

SEQ ID NO: 245808 - DNA, 23 bp, Artificial sequence
  SiRNA target sequence
atatttggtaattttagaaaatg

SEQ ID NO: 245809 - DNA, 23 bp, Artificial sequence
  SiRNA target sequence
tatttggtaattttagaaaatgc

SEQ ID NO: 245810 - DNA, 23 bp, Artificial sequence
  SiRNA target sequence
atttggtaattttagaaaatgca

SEQ ID NO: 245811 - DNA, 23 bp, Artificial sequence
  SiRNA target sequence
tttggtaattttagaaaatgcaa

SEQ ID NO: 245812 - DNA, 23 bp, Artificial sequence
  SiRNA target sequence
ttggtaattttagaaaatgcaaa

SEQ ID NO: 245813 - DNA, 23 bp, Artificial sequence
  SiRNA target sequence
tggtaattttagaaaatgcaaat

SEQ ID NO: 245814 - DNA, 23 bp, Artificial sequence
  SiRNA target sequence
ggtaattttagaaaatgcaaatc

SEQ ID NO: 245815 - DNA, 23 bp, Artificial sequence
  SiRNA target sequence
gtaattttagaaaatgcaaatcc

SEQ ID NO: 245816 - DNA, 23 bp, Artificial sequence
  SiRNA target sequence
taattttagaaaatgcaaatcca

SEQ ID NO: 245817 - DNA, 23 bp, Artificial sequence
  SiRNA target sequence
aattttagaaaatgcaaatccaa

SEQ ID NO: 245818 - DNA, 23 bp, Artificial sequence
  SiRNA target sequence
attttagaaaatgcaaatccaat

SEQ ID NO: 245819 - DNA, 23 bp, Artificial sequence
  SiRNA target sequence
ttttagaaaatgcaaatccaatg

SEQ ID NO: 245820 - DNA, 23 bp, Artificial sequence
  SiRNA target sequence
tttagaaaatgcaaatccaatgg

SEQ ID NO: 245821 - DNA, 23 bp, Artificial sequence
  SiRNA target sequence
ttagaaaatgcaaatccaatggt

SEQ ID NO: 245822 - DNA, 23 bp, Artificial sequence
  SiRNA target sequence
tagaaaatgcaaatccaatggtt

SEQ ID NO: 245823 - DNA, 23 bp, Artificial sequence
  SiRNA target sequence
agaaaatgcaaatccaatggttg

SEQ ID NO: 245824 - DNA, 23 bp, Artificial sequence
  SiRNA target sequence
gaaaatgcaaatccaatggttgc

SEQ ID NO: 245825 - DNA, 23 bp, Artificial sequence
  SiRNA target sequence
aaaatgcaaatccaatggttgca

SEQ ID NO: 245826 - DNA, 23 bp, Artificial sequence
  SiRNA target sequence
aaatgcaaatccaatggttgcac

SEQ ID NO: 245827 - DNA, 23 bp, Artificial sequence
  SiRNA target sequence
aatgcaaatccaatggttgcaca

SEQ ID NO: 245828 - DNA, 23 bp, Artificial sequence
  SiRNA target sequence
atgcaaatccaatggttgcacac

SEQ ID NO: 245829 - DNA, 23 bp, Artificial sequence
  SiRNA target sequence
tgcaaatccaatggttgcacacc

SEQ ID NO: 245830 - DNA, 23 bp, Artificial sequence
  SiRNA target sequence
gcaaatccaatggttgcacacca

SEQ ID NO: 245831 - DNA, 23 bp, Artificial sequence
  SiRNA target sequence
caaatccaatggttgcacaccaa

SEQ ID NO: 245832 - DNA, 23 bp, Artificial sequence
  SiRNA target sequence
aaatccaatggttgcacaccaat

SEQ ID NO: 245833 - DNA, 23 bp, Artificial sequence
  SiRNA target sequence
aatccaatggttgcacaccaatt

SEQ ID NO: 245834 - DNA, 23 bp, Artificial sequence
  SiRNA target sequence
atccaatggttgcacaccaattt

SEQ ID NO: 245835 - DNA, 23 bp, Artificial sequence
  SiRNA target sequence
tccaatggttgcacaccaatttt

SEQ ID NO: 245836 - DNA, 23 bp, Artificial sequence
  SiRNA target sequence
ccaatggttgcacaccaattttc

SEQ ID NO: 245837 - DNA, 23 bp, Artificial sequence
  SiRNA target sequence
caatggttgcacaccaattttca

SEQ ID NO: 245838 - DNA, 23 bp, Artificial sequence
  SiRNA target sequence
aatggttgcacaccaattttcaa

SEQ ID NO: 245839 - DNA, 23 bp, Artificial sequence
  SiRNA target sequence
atggttgcacaccaattttcaag

SEQ ID NO: 245840 - DNA, 23 bp, Artificial sequence
  SiRNA target sequence
tggttgcacaccaattttcaaga

SEQ ID NO: 245841 - DNA, 23 bp, Artificial sequence
  SiRNA target sequence
ggttgcacaccaattttcaagat

SEQ ID NO: 245842 - DNA, 23 bp, Artificial sequence
  SiRNA target sequence
gttgcacaccaattttcaagatt

SEQ ID NO: 245843 - DNA, 23 bp, Artificial sequence
  SiRNA target sequence
ttgcacaccaattttcaagattt

SEQ ID NO: 245844 - DNA, 23 bp, Artificial sequence
  SiRNA target sequence
tgcacaccaattttcaagattta

SEQ ID NO: 245845 - DNA, 23 bp, Artificial sequence
  SiRNA target sequence
gcacaccaattttcaagatttat

SEQ ID NO: 245846 - DNA, 23 bp, Artificial sequence
  SiRNA target sequence
cacaccaattttcaagatttatt

SEQ ID NO: 245847 - DNA, 23 bp, Artificial sequence
  SiRNA target sequence
acaccaattttcaagatttattc

SEQ ID NO: 245848 - DNA, 23 bp, Artificial sequence
  SiRNA target sequence
caccaattttcaagatttattct

SEQ ID NO: 245849 - DNA, 23 bp, Artificial sequence
  SiRNA target sequence
accaattttcaagatttattctt

SEQ ID NO: 245850 - DNA, 23 bp, Artificial sequence
  SiRNA target sequence
ccaattttcaagatttattctta

SEQ ID NO: 245851 - DNA, 23 bp, Artificial sequence
  SiRNA target sequence
caattttcaagatttattcttaa

SEQ ID NO: 245852 - DNA, 23 bp, Artificial sequence
  SiRNA target sequence
aattttcaagatttattcttaag

SEQ ID NO: 245853 - DNA, 23 bp, Artificial sequence
  SiRNA target sequence
attttcaagatttattcttaaga

SEQ ID NO: 245854 - DNA, 23 bp, Artificial sequence
  SiRNA target sequence
ttttcaagatttattcttaagac

SEQ ID NO: 245855 - DNA, 23 bp, Artificial sequence
  SiRNA target sequence
tttcaagatttattcttaagacc

SEQ ID NO: 245856 - DNA, 23 bp, Artificial sequence
  SiRNA target sequence
ttcaagatttattcttaagaccg

SEQ ID NO: 245857 - DNA, 23 bp, Artificial sequence
  SiRNA target sequence
tcaagatttattcttaagaccga

SEQ ID NO: 245858 - DNA, 23 bp, Artificial sequence
  SiRNA target sequence
caagatttattcttaagaccgat

SEQ ID NO: 245859 - DNA, 23 bp, Artificial sequence
  SiRNA target sequence
aagatttattcttaagaccgatg

SEQ ID NO: 245860 - DNA, 23 bp, Artificial sequence
  SiRNA target sequence
agatttattcttaagaccgatgg

SEQ ID NO: 245861 - DNA, 23 bp, Artificial sequence
  SiRNA target sequence
gatttattcttaagaccgatgga

SEQ ID NO: 245862 - DNA, 23 bp, Artificial sequence
  SiRNA target sequence
atttattcttaagaccgatggag

SEQ ID NO: 245863 - DNA, 23 bp, Artificial sequence
  SiRNA target sequence
tttattcttaagaccgatggagc

SEQ ID NO: 245864 - DNA, 23 bp, Artificial sequence
  SiRNA target sequence
ttattcttaagaccgatggagct

SEQ ID NO: 245865 - DNA, 23 bp, Artificial sequence
  SiRNA target sequence
tattcttaagaccgatggagctg

SEQ ID NO: 245866 - DNA, 23 bp, Artificial sequence
  SiRNA target sequence
attcttaagaccgatggagctgt

SEQ ID NO: 245867 - DNA, 23 bp, Artificial sequence
  SiRNA target sequence
ttcttaagaccgatggagctgtg

SEQ ID NO: 245868 - DNA, 23 bp, Artificial sequence
  SiRNA target sequence
tcttaagaccgatggagctgtgc

SEQ ID NO: 245869 - DNA, 23 bp, Artificial sequence
  SiRNA target sequence
cttaagaccgatggagctgtgcg

SEQ ID NO: 245870 - DNA, 23 bp, Artificial sequence
  SiRNA target sequence
ttaagaccgatggagctgtgcgc

SEQ ID NO: 245871 - DNA, 23 bp, Artificial sequence
  SiRNA target sequence
taagaccgatggagctgtgcgca

SEQ ID NO: 245872 - DNA, 23 bp, Artificial sequence
  SiRNA target sequence
aagaccgatggagctgtgcgcaa

SEQ ID NO: 245873 - DNA, 23 bp, Artificial sequence
  SiRNA target sequence
agaccgatggagctgtgcgcaaa

SEQ ID NO: 245874 - DNA, 23 bp, Artificial sequence
  SiRNA target sequence
gaccgatggagctgtgcgcaaat

SEQ ID NO: 245875 - DNA, 23 bp, Artificial sequence
  SiRNA target sequence
accgatggagctgtgcgcaaatt

SEQ ID NO: 245876 - DNA, 23 bp, Artificial sequence
  SiRNA target sequence
ccgatggagctgtgcgcaaattg

SEQ ID NO: 245877 - DNA, 23 bp, Artificial sequence
  SiRNA target sequence
cgatggagctgtgcgcaaattgt

SEQ ID NO: 245878 - DNA, 23 bp, Artificial sequence
  SiRNA target sequence
gatggagctgtgcgcaaattgta

SEQ ID NO: 245879 - DNA, 23 bp, Artificial sequence
  SiRNA target sequence
atggagctgtgcgcaaattgtaa

SEQ ID NO: 245880 - DNA, 23 bp, Artificial sequence
  SiRNA target sequence
tggagctgtgcgcaaattgtaaa

SEQ ID NO: 245881 - DNA, 23 bp, Artificial sequence
  SiRNA target sequence
ggagctgtgcgcaaattgtaaaa

SEQ ID NO: 245882 - DNA, 23 bp, Artificial sequence
  SiRNA target sequence
gagctgtgcgcaaattgtaaaaa

SEQ ID NO: 245883 - DNA, 23 bp, Artificial sequence
  SiRNA target sequence
agctgtgcgcaaattgtaaaaag

SEQ ID NO: 245884 - DNA, 23 bp, Artificial sequence
  SiRNA target sequence
gctgtgcgcaaattgtaaaaaga

SEQ ID NO: 245885 - DNA, 23 bp, Artificial sequence
  SiRNA target sequence
ctgtgcgcaaattgtaaaaagaa

SEQ ID NO: 245886 - DNA, 23 bp, Artificial sequence
  SiRNA target sequence
tgtgcgcaaattgtaaaaagaaa

SEQ ID NO: 245887 - DNA, 23 bp, Artificial sequence
  SiRNA target sequence
gtgcgcaaattgtaaaaagaaag

SEQ ID NO: 245888 - DNA, 23 bp, Artificial sequence
  SiRNA target sequence
tgcgcaaattgtaaaaagaaagt

SEQ ID NO: 245889 - DNA, 23 bp, Artificial sequence
  SiRNA target sequence
gcgcaaattgtaaaaagaaagtc

SEQ ID NO: 245890 - DNA, 23 bp, Artificial sequence
  SiRNA target sequence
cgcaaattgtaaaaagaaagtcc

SEQ ID NO: 245891 - DNA, 23 bp, Artificial sequence
  SiRNA target sequence
gcaaattgtaaaaagaaagtcct

SEQ ID NO: 245892 - DNA, 23 bp, Artificial sequence
  SiRNA target sequence
caaattgtaaaaagaaagtcctg

SEQ ID NO: 245893 - DNA, 23 bp, Artificial sequence
  SiRNA target sequence
aaattgtaaaaagaaagtcctga

SEQ ID NO: 245894 - DNA, 23 bp, Artificial sequence
  SiRNA target sequence
aattgtaaaaagaaagtcctgaa

SEQ ID NO: 245895 - DNA, 23 bp, Artificial sequence
  SiRNA target sequence
attgtaaaaagaaagtcctgaaa

SEQ ID NO: 245896 - DNA, 23 bp, Artificial sequence
  SiRNA target sequence
ttgtaaaaagaaagtcctgaaat

SEQ ID NO: 245897 - DNA, 23 bp, Artificial sequence
  SiRNA target sequence
tgtaaaaagaaagtcctgaaatt

SEQ ID NO: 245898 - DNA, 23 bp, Artificial sequence
  SiRNA target sequence
gtaaaaagaaagtcctgaaatta

SEQ ID NO: 245899 - DNA, 23 bp, Artificial sequence
  SiRNA target sequence
taaaaagaaagtcctgaaattag

SEQ ID NO: 245900 - DNA, 23 bp, Artificial sequence
  SiRNA target sequence
aaaaagaaagtcctgaaattaga

SEQ ID NO: 245901 - DNA, 23 bp, Artificial sequence
  SiRNA target sequence
aaaagaaagtcctgaaattagag

SEQ ID NO: 245902 - DNA, 23 bp, Artificial sequence
  SiRNA target sequence
aaagaaagtcctgaaattagagc

SEQ ID NO: 245903 - DNA, 23 bp, Artificial sequence
  SiRNA target sequence
aagaaagtcctgaaattagagcg

SEQ ID NO: 245904 - DNA, 23 bp, Artificial sequence
  SiRNA target sequence
agaaagtcctgaaattagagcgg

SEQ ID NO: 245905 - DNA, 23 bp, Artificial sequence
  SiRNA target sequence
gaaagtcctgaaattagagcggt

SEQ ID NO: 245906 - DNA, 23 bp, Artificial sequence
  SiRNA target sequence
aaagtcctgaaattagagcggta

SEQ ID NO: 245907 - DNA, 23 bp, Artificial sequence
  SiRNA target sequence
aagtcctgaaattagagcggtaa

SEQ ID NO: 245908 - DNA, 23 bp, Artificial sequence
  SiRNA target sequence
agtcctgaaattagagcggtaaa

SEQ ID NO: 245909 - DNA, 23 bp, Artificial sequence
  SiRNA target sequence
gtcctgaaattagagcggtaaaa

SEQ ID NO: 245910 - DNA, 23 bp, Artificial sequence
  SiRNA target sequence
tcctgaaattagagcggtaaaaa

SEQ ID NO: 245911 - DNA, 23 bp, Artificial sequence
  SiRNA target sequence
cctgaaattagagcggtaaaaaa

SEQ ID NO: 245912 - DNA, 23 bp, Artificial sequence
  SiRNA target sequence
ctgaaattagagcggtaaaaaat

SEQ ID NO: 245913 - DNA, 23 bp, Artificial sequence
  SiRNA target sequence
tgaaattagagcggtaaaaaata

SEQ ID NO: 245914 - DNA, 23 bp, Artificial sequence
  SiRNA target sequence
gaaattagagcggtaaaaaatat

SEQ ID NO: 245915 - DNA, 23 bp, Artificial sequence
  SiRNA target sequence
aaattagagcggtaaaaaatata

SEQ ID NO: 245916 - DNA, 23 bp, Artificial sequence
  SiRNA target sequence
aattagagcggtaaaaaatatag

SEQ ID NO: 245917 - DNA, 23 bp, Artificial sequence
  SiRNA target sequence
attagagcggtaaaaaatatagc

SEQ ID NO: 245918 - DNA, 23 bp, Artificial sequence
  SiRNA target sequence
ttagagcggtaaaaaatatagca

SEQ ID NO: 245919 - DNA, 23 bp, Artificial sequence
  SiRNA target sequence
tagagcggtaaaaaatatagcag

SEQ ID NO: 245920 - DNA, 23 bp, Artificial sequence
  SiRNA target sequence
agagcggtaaaaaatatagcagc

SEQ ID NO: 245921 - DNA, 23 bp, Artificial sequence
  SiRNA target sequence
gagcggtaaaaaatatagcagca

SEQ ID NO: 245922 - DNA, 23 bp, Artificial sequence
  SiRNA target sequence
agcggtaaaaaatatagcagcaa

SEQ ID NO: 245923 - DNA, 23 bp, Artificial sequence
  SiRNA target sequence
gcggtaaaaaatatagcagcaat

SEQ ID NO: 245924 - DNA, 23 bp, Artificial sequence
  SiRNA target sequence
cggtaaaaaatatagcagcaata

SEQ ID NO: 245925 - DNA, 23 bp, Artificial sequence
  SiRNA target sequence
ggtaaaaaatatagcagcaatag

SEQ ID NO: 245926 - DNA, 23 bp, Artificial sequence
  SiRNA target sequence
gtaaaaaatatagcagcaatagg

SEQ ID NO: 245927 - DNA, 23 bp, Artificial sequence
  SiRNA target sequence
taaaaaatatagcagcaataggg

SEQ ID NO: 245928 - DNA, 23 bp, Artificial sequence
  SiRNA target sequence
aaaaaatatagcagcaatagggg

SEQ ID NO: 245929 - DNA, 23 bp, Artificial sequence
  SiRNA target sequence
aaaaatatagcagcaatagggga

SEQ ID NO: 245930 - DNA, 23 bp, Artificial sequence
  SiRNA target sequence
aaaatatagcagcaataggggag

SEQ ID NO: 245931 - DNA, 23 bp, Artificial sequence
  SiRNA target sequence
aaatatagcagcaataggggagg

SEQ ID NO: 245932 - DNA, 23 bp, Artificial sequence
  SiRNA target sequence
aatatagcagcaataggggaggc

SEQ ID NO: 245933 - DNA, 23 bp, Artificial sequence
  SiRNA target sequence
atatagcagcaataggggaggca

SEQ ID NO: 245934 - DNA, 23 bp, Artificial sequence
  SiRNA target sequence
tatagcagcaataggggaggcaa

SEQ ID NO: 245935 - DNA, 23 bp, Artificial sequence
  SiRNA target sequence
atagcagcaataggggaggcaat

SEQ ID NO: 245936 - DNA, 23 bp, Artificial sequence
  SiRNA target sequence
tagcagcaataggggaggcaata

SEQ ID NO: 245937 - DNA, 23 bp, Artificial sequence
  SiRNA target sequence
agcagcaataggggaggcaatag

SEQ ID NO: 245938 - DNA, 23 bp, Artificial sequence
  SiRNA target sequence
gcagcaataggggaggcaataga

SEQ ID NO: 245939 - DNA, 23 bp, Artificial sequence
  SiRNA target sequence
cagcaataggggaggcaatagat

SEQ ID NO: 245940 - DNA, 23 bp, Artificial sequence
  SiRNA target sequence
agcaataggggaggcaatagata

SEQ ID NO: 245941 - DNA, 23 bp, Artificial sequence
  SiRNA target sequence
gcaataggggaggcaatagatag

SEQ ID NO: 245942 - DNA, 23 bp, Artificial sequence
  SiRNA target sequence
caataggggaggcaatagataga

SEQ ID NO: 245943 - DNA, 23 bp, Artificial sequence
  SiRNA target sequence
aataggggaggcaatagatagat

SEQ ID NO: 245944 - DNA, 23 bp, Artificial sequence
  SiRNA target sequence
ataggggaggcaatagatagata

SEQ ID NO: 245945 - DNA, 23 bp, Artificial sequence
  SiRNA target sequence
taggggaggcaatagatagataa

SEQ ID NO: 245946 - DNA, 23 bp, Artificial sequence
  SiRNA target sequence
aggggaggcaatagatagataaa

SEQ ID NO: 245947 - DNA, 23 bp, Artificial sequence
  SiRNA target sequence
ggggaggcaatagatagataaaa

SEQ ID NO: 245948 - DNA, 23 bp, Artificial sequence
  SiRNA target sequence
gggaggcaatagatagataaaag

SEQ ID NO: 245949 - DNA, 23 bp, Artificial sequence
  SiRNA target sequence
ggaggcaatagatagataaaaga

SEQ ID NO: 245950 - DNA, 23 bp, Artificial sequence
  SiRNA target sequence
gaggcaatagatagataaaagat

SEQ ID NO: 245951 - DNA, 23 bp, Artificial sequence
  SiRNA target sequence
aggcaatagatagataaaagatc

SEQ ID NO: 245952 - DNA, 23 bp, Artificial sequence
  SiRNA target sequence
ggcaatagatagataaaagatcc

SEQ ID NO: 245953 - DNA, 23 bp, Artificial sequence
  SiRNA target sequence
gcaatagatagataaaagatcct

SEQ ID NO: 245954 - DNA, 23 bp, Artificial sequence
  SiRNA target sequence
caatagatagataaaagatcctt

SEQ ID NO: 245955 - DNA, 23 bp, Artificial sequence
  SiRNA target sequence
aatagatagataaaagatccttg

SEQ ID NO: 245956 - DNA, 23 bp, Artificial sequence
  SiRNA target sequence
atagatagataaaagatccttga

SEQ ID NO: 245957 - DNA, 23 bp, Artificial sequence
  SiRNA target sequence
tagatagataaaagatccttgat

SEQ ID NO: 245958 - DNA, 23 bp, Artificial sequence
  SiRNA target sequence
agatagataaaagatccttgatg

SEQ ID NO: 245959 - DNA, 23 bp, Artificial sequence
  SiRNA target sequence
gatagataaaagatccttgatgc

SEQ ID NO: 245960 - DNA, 23 bp, Artificial sequence
  SiRNA target sequence
atagataaaagatccttgatgca

SEQ ID NO: 245961 - DNA, 23 bp, Artificial sequence
  SiRNA target sequence
tagataaaagatccttgatgcaa

SEQ ID NO: 245962 - DNA, 23 bp, Artificial sequence
  SiRNA target sequence
agataaaagatccttgatgcaat

SEQ ID NO: 245963 - DNA, 23 bp, Artificial sequence
  SiRNA target sequence
gataaaagatccttgatgcaatg

SEQ ID NO: 245964 - DNA, 23 bp, Artificial sequence
  SiRNA target sequence
ataaaagatccttgatgcaatgc

SEQ ID NO: 245965 - DNA, 23 bp, Artificial sequence
  SiRNA target sequence
taaaagatccttgatgcaatgcg

SEQ ID NO: 245966 - DNA, 23 bp, Artificial sequence
  SiRNA target sequence
aaaagatccttgatgcaatgcga

SEQ ID NO: 245967 - DNA, 23 bp, Artificial sequence
  SiRNA target sequence
aaagatccttgatgcaatgcgat

SEQ ID NO: 245968 - DNA, 23 bp, Artificial sequence
  SiRNA target sequence
aagatccttgatgcaatgcgatt

SEQ ID NO: 245969 - DNA, 23 bp, Artificial sequence
  SiRNA target sequence
agatccttgatgcaatgcgattt

SEQ ID NO: 245970 - DNA, 23 bp, Artificial sequence
  SiRNA target sequence
gatccttgatgcaatgcgatttc

SEQ ID NO: 245971 - DNA, 23 bp, Artificial sequence
  SiRNA target sequence
atccttgatgcaatgcgatttcc

SEQ ID NO: 245972 - DNA, 23 bp, Artificial sequence
  SiRNA target sequence
tccttgatgcaatgcgatttcca

SEQ ID NO: 245973 - DNA, 23 bp, Artificial sequence
  SiRNA target sequence
ccttgatgcaatgcgatttccac

SEQ ID NO: 245974 - DNA, 23 bp, Artificial sequence
  SiRNA target sequence
cttgatgcaatgcgatttccacg

SEQ ID NO: 245975 - DNA, 23 bp, Artificial sequence
  SiRNA target sequence
ttgatgcaatgcgatttccacgg

SEQ ID NO: 245976 - DNA, 23 bp, Artificial sequence
  SiRNA target sequence
tgatgcaatgcgatttccacgga

SEQ ID NO: 245977 - DNA, 23 bp, Artificial sequence
  SiRNA target sequence
gatgcaatgcgatttccacggat

SEQ ID NO: 245978 - DNA, 23 bp, Artificial sequence
  SiRNA target sequence
atgcaatgcgatttccacggatt

SEQ ID NO: 245979 - DNA, 23 bp, Artificial sequence
  SiRNA target sequence
tgcaatgcgatttccacggatta

SEQ ID NO: 245980 - DNA, 23 bp, Artificial sequence
  SiRNA target sequence
gcaatgcgatttccacggattac

SEQ ID NO: 245981 - DNA, 23 bp, Artificial sequence
  SiRNA target sequence
caatgcgatttccacggattaca

SEQ ID NO: 245982 - DNA, 23 bp, Artificial sequence
  SiRNA target sequence
aatgcgatttccacggattacaa

SEQ ID NO: 245983 - DNA, 23 bp, Artificial sequence
  SiRNA target sequence
atgcgatttccacggattacaaa

SEQ ID NO: 245984 - DNA, 23 bp, Artificial sequence
  SiRNA target sequence
tgcgatttccacggattacaaag

SEQ ID NO: 245985 - DNA, 23 bp, Artificial sequence
  SiRNA target sequence
gcgatttccacggattacaaagt

SEQ ID NO: 245986 - DNA, 23 bp, Artificial sequence
  SiRNA target sequence
cgatttccacggattacaaagtt

SEQ ID NO: 245987 - DNA, 23 bp, Artificial sequence
  SiRNA target sequence
gatttccacggattacaaagtta

SEQ ID NO: 245988 - DNA, 23 bp, Artificial sequence
  SiRNA target sequence
atttccacggattacaaagttat

SEQ ID NO: 245989 - DNA, 23 bp, Artificial sequence
  SiRNA target sequence
tttccacggattacaaagttata

SEQ ID NO: 245990 - DNA, 23 bp, Artificial sequence
  SiRNA target sequence
ttccacggattacaaagttataa

SEQ ID NO: 245991 - DNA, 23 bp, Artificial sequence
  SiRNA target sequence
tccacggattacaaagttataaa

SEQ ID NO: 245992 - DNA, 23 bp, Artificial sequence
  SiRNA target sequence
ccacggattacaaagttataaaa

SEQ ID NO: 245993 - DNA, 23 bp, Artificial sequence
  SiRNA target sequence
cacggattacaaagttataaaat

SEQ ID NO: 245994 - DNA, 23 bp, Artificial sequence
  SiRNA target sequence
acggattacaaagttataaaata

SEQ ID NO: 245995 - DNA, 23 bp, Artificial sequence
  SiRNA target sequence
cggattacaaagttataaaataa

SEQ ID NO: 245996 - DNA, 23 bp, Artificial sequence
  SiRNA target sequence
ggattacaaagttataaaataat

SEQ ID NO: 245997 - DNA, 23 bp, Artificial sequence
  SiRNA target sequence
gattacaaagttataaaataatg

SEQ ID NO: 245998 - DNA, 23 bp, Artificial sequence
  SiRNA target sequence
attacaaagttataaaataatga

SEQ ID NO: 245999 - DNA, 23 bp, Artificial sequence
  SiRNA target sequence
ttacaaagttataaaataatgat

SEQ ID NO: 246000 - DNA, 23 bp, Artificial sequence
  SiRNA target sequence
tacaaagttataaaataatgata

SEQ ID NO: 246001 - DNA, 23 bp, Artificial sequence
  SiRNA target sequence
acaaagttataaaataatgatac

SEQ ID NO: 246002 - DNA, 23 bp, Artificial sequence
  SiRNA target sequence
caaagttataaaataatgataca

SEQ ID NO: 246003 - DNA, 23 bp, Artificial sequence
  SiRNA target sequence
aaagttataaaataatgatacag

SEQ ID NO: 246004 - DNA, 23 bp, Artificial sequence
  SiRNA target sequence
aagttataaaataatgatacagc

SEQ ID NO: 246005 - DNA, 23 bp, Artificial sequence
  SiRNA target sequence
agttataaaataatgatacagca

SEQ ID NO: 246006 - DNA, 23 bp, Artificial sequence
  SiRNA target sequence
gttataaaataatgatacagcac

SEQ ID NO: 246007 - DNA, 23 bp, Artificial sequence
  SiRNA target sequence
ttataaaataatgatacagcact

SEQ ID NO: 246008 - DNA, 23 bp, Artificial sequence
  SiRNA target sequence
tataaaataatgatacagcacta

SEQ ID NO: 246009 - DNA, 23 bp, Artificial sequence
  SiRNA target sequence
ataaaataatgatacagcactaa

SEQ ID NO: 246010 - DNA, 23 bp, Artificial sequence
  SiRNA target sequence
taaaataatgatacagcactaat

SEQ ID NO: 246011 - DNA, 23 bp, Artificial sequence
  SiRNA target sequence
aaaataatgatacagcactaatc

SEQ ID NO: 246012 - DNA, 23 bp, Artificial sequence
  SiRNA target sequence
aaataatgatacagcactaatcg

SEQ ID NO: 246013 - DNA, 23 bp, Artificial sequence
  SiRNA target sequence
aataatgatacagcactaatcgt

SEQ ID NO: 246014 - DNA, 23 bp, Artificial sequence
  SiRNA target sequence
ataatgatacagcactaatcgtt

SEQ ID NO: 246015 - DNA, 23 bp, Artificial sequence
  SiRNA target sequence
taatgatacagcactaatcgtta

SEQ ID NO: 246016 - DNA, 23 bp, Artificial sequence
  SiRNA target sequence
aatgatacagcactaatcgttaa

SEQ ID NO: 246017 - DNA, 23 bp, Artificial sequence
  SiRNA target sequence
atgatacagcactaatcgttaag

SEQ ID NO: 246018 - DNA, 23 bp, Artificial sequence
  SiRNA target sequence
tgatacagcactaatcgttaagg

SEQ ID NO: 246019 - DNA, 23 bp, Artificial sequence
  SiRNA target sequence
gatacagcactaatcgttaagga

SEQ ID NO: 246020 - DNA, 23 bp, Artificial sequence
  SiRNA target sequence
atacagcactaatcgttaaggaa

SEQ ID NO: 246021 - DNA, 23 bp, Artificial sequence
  SiRNA target sequence
tacagcactaatcgttaaggaag

SEQ ID NO: 246022 - DNA, 23 bp, Artificial sequence
  SiRNA target sequence
acagcactaatcgttaaggaagt

SEQ ID NO: 246023 - DNA, 23 bp, Artificial sequence
  SiRNA target sequence
cagcactaatcgttaaggaagtt

SEQ ID NO: 246024 - DNA, 23 bp, Artificial sequence
  SiRNA target sequence
agcactaatcgttaaggaagttg

SEQ ID NO: 246025 - DNA, 23 bp, Artificial sequence
  SiRNA target sequence
gcactaatcgttaaggaagttgt

SEQ ID NO: 246026 - DNA, 23 bp, Artificial sequence
  SiRNA target sequence
cactaatcgttaaggaagttgtt

SEQ ID NO: 246027 - DNA, 23 bp, Artificial sequence
  SiRNA target sequence
actaatcgttaaggaagttgtta

SEQ ID NO: 246028 - DNA, 23 bp, Artificial sequence
  SiRNA target sequence
ctaatcgttaaggaagttgttac

SEQ ID NO: 246029 - DNA, 23 bp, Artificial sequence
  SiRNA target sequence
taatcgttaaggaagttgttact

SEQ ID NO: 246030 - DNA, 23 bp, Artificial sequence
  SiRNA target sequence
aatcgttaaggaagttgttacta

SEQ ID NO: 246031 - DNA, 23 bp, Artificial sequence
  SiRNA target sequence
atcgttaaggaagttgttactaa

SEQ ID NO: 246032 - DNA, 23 bp, Artificial sequence
  SiRNA target sequence
tcgttaaggaagttgttactaaa

SEQ ID NO: 246033 - DNA, 23 bp, Artificial sequence
  SiRNA target sequence
cgttaaggaagttgttactaaat

SEQ ID NO: 246034 - DNA, 23 bp, Artificial sequence
  SiRNA target sequence
gttaaggaagttgttactaaata

SEQ ID NO: 246035 - DNA, 23 bp, Artificial sequence
  SiRNA target sequence
ttaaggaagttgttactaaatat

SEQ ID NO: 246036 - DNA, 23 bp, Artificial sequence
  SiRNA target sequence
taaggaagttgttactaaatatt

SEQ ID NO: 246037 - DNA, 23 bp, Artificial sequence
  SiRNA target sequence
aaggaagttgttactaaatattt

SEQ ID NO: 246038 - DNA, 23 bp, Artificial sequence
  SiRNA target sequence
aggaagttgttactaaatatttt

SEQ ID NO: 246039 - DNA, 23 bp, Artificial sequence
  SiRNA target sequence
ggaagttgttactaaatattttt

SEQ ID NO: 246040 - DNA, 23 bp, Artificial sequence
  SiRNA target sequence
gaagttgttactaaatatttttg

SEQ ID NO: 246041 - DNA, 23 bp, Artificial sequence
  SiRNA target sequence
aagttgttactaaatatttttga

SEQ ID NO: 246042 - DNA, 23 bp, Artificial sequence
  SiRNA target sequence
agttgttactaaatatttttgag

SEQ ID NO: 246043 - DNA, 23 bp, Artificial sequence
  SiRNA target sequence
gttgttactaaatatttttgaga

SEQ ID NO: 246044 - DNA, 23 bp, Artificial sequence
  SiRNA target sequence
ttgttactaaatatttttgagaa

SEQ ID NO: 246045 - DNA, 23 bp, Artificial sequence
  SiRNA target sequence
tgttactaaatatttttgagaat

SEQ ID NO: 246046 - DNA, 23 bp, Artificial sequence
  SiRNA target sequence
gttactaaatatttttgagaata

SEQ ID NO: 246047 - DNA, 23 bp, Artificial sequence
  SiRNA target sequence
ttactaaatatttttgagaataa

SEQ ID NO: 246048 - DNA, 23 bp, Artificial sequence
  SiRNA target sequence
tactaaatatttttgagaataat

SEQ ID NO: 246049 - DNA, 23 bp, Artificial sequence
  SiRNA target sequence
actaaatatttttgagaataatc

SEQ ID NO: 246050 - DNA, 23 bp, Artificial sequence
  SiRNA target sequence
ctaaatatttttgagaataatct

SEQ ID NO: 246051 - DNA, 23 bp, Artificial sequence
  SiRNA target sequence
taaatatttttgagaataatctt

SEQ ID NO: 246052 - DNA, 23 bp, Artificial sequence
  SiRNA target sequence
aaatatttttgagaataatcttt

SEQ ID NO: 246053 - DNA, 23 bp, Artificial sequence
  SiRNA target sequence
aatatttttgagaataatctttc

SEQ ID NO: 246054 - DNA, 23 bp, Artificial sequence
  SiRNA target sequence
atatttttgagaataatctttcg

SEQ ID NO: 246055 - DNA, 23 bp, Artificial sequence
  SiRNA target sequence
tatttttgagaataatctttcgg

SEQ ID NO: 246056 - DNA, 23 bp, Artificial sequence
  SiRNA target sequence
atttttgagaataatctttcgga

SEQ ID NO: 246057 - DNA, 23 bp, Artificial sequence
  SiRNA target sequence
tttttgagaataatctttcggag

SEQ ID NO: 246058 - DNA, 23 bp, Artificial sequence
  SiRNA target sequence
ttttgagaataatctttcggagg

SEQ ID NO: 246059 - DNA, 23 bp, Artificial sequence
  SiRNA target sequence
tttgagaataatctttcggaggc

SEQ ID NO: 246060 - DNA, 23 bp, Artificial sequence
  SiRNA target sequence
ttgagaataatctttcggaggca

SEQ ID NO: 246061 - DNA, 23 bp, Artificial sequence
  SiRNA target sequence
tgagaataatctttcggaggcat

SEQ ID NO: 246062 - DNA, 23 bp, Artificial sequence
  SiRNA target sequence
gagaataatctttcggaggcata

SEQ ID NO: 246063 - DNA, 23 bp, Artificial sequence
  SiRNA target sequence
agaataatctttcggaggcatat

SEQ ID NO: 246064 - DNA, 23 bp, Artificial sequence
  SiRNA target sequence
gaataatctttcggaggcatatt

SEQ ID NO: 246065 - DNA, 23 bp, Artificial sequence
  SiRNA target sequence
aataatctttcggaggcatatta

SEQ ID NO: 246066 - DNA, 23 bp, Artificial sequence
  SiRNA target sequence
ataatctttcggaggcatattat

SEQ ID NO: 246067 - DNA, 23 bp, Artificial sequence
  SiRNA target sequence
taatctttcggaggcatattatt

SEQ ID NO: 246068 - DNA, 23 bp, Artificial sequence
  SiRNA target sequence
aatctttcggaggcatattatta

SEQ ID NO: 246069 - DNA, 23 bp, Artificial sequence
  SiRNA target sequence
atctttcggaggcatattattaa

SEQ ID NO: 246070 - DNA, 23 bp, Artificial sequence
  SiRNA target sequence
tctttcggaggcatattattaat

SEQ ID NO: 246071 - DNA, 23 bp, Artificial sequence
  SiRNA target sequence
ctttcggaggcatattattaatt

SEQ ID NO: 246072 - DNA, 23 bp, Artificial sequence
  SiRNA target sequence
tttcggaggcatattattaattc

SEQ ID NO: 246073 - DNA, 23 bp, Artificial sequence
  SiRNA target sequence
ttcggaggcatattattaattct

SEQ ID NO: 246074 - DNA, 23 bp, Artificial sequence
  SiRNA target sequence
tcggaggcatattattaattctg

SEQ ID NO: 246075 - DNA, 23 bp, Artificial sequence
  SiRNA target sequence
cggaggcatattattaattctgc

SEQ ID NO: 246076 - DNA, 23 bp, Artificial sequence
  SiRNA target sequence
ggaggcatattattaattctgct

SEQ ID NO: 246077 - DNA, 23 bp, Artificial sequence
  SiRNA target sequence
gaggcatattattaattctgctt

SEQ ID NO: 246078 - DNA, 23 bp, Artificial sequence
  SiRNA target sequence
aggcatattattaattctgcttc

SEQ ID NO: 246079 - DNA, 23 bp, Artificial sequence
  SiRNA target sequence
ggcatattattaattctgcttcc

SEQ ID NO: 246080 - DNA, 23 bp, Artificial sequence
  SiRNA target sequence
gcatattattaattctgcttccc

SEQ ID NO: 246081 - DNA, 23 bp, Artificial sequence
  SiRNA target sequence
catattattaattctgcttcccg

SEQ ID NO: 246082 - DNA, 23 bp, Artificial sequence
  SiRNA target sequence
atattattaattctgcttcccgt

SEQ ID NO: 246083 - DNA, 23 bp, Artificial sequence
  SiRNA target sequence
tattattaattctgcttcccgta

SEQ ID NO: 246084 - DNA, 23 bp, Artificial sequence
  SiRNA target sequence
attattaattctgcttcccgtag

SEQ ID NO: 246085 - DNA, 23 bp, Artificial sequence
  SiRNA target sequence
ttattaattctgcttcccgtaga

SEQ ID NO: 246086 - DNA, 23 bp, Artificial sequence
  SiRNA target sequence
tattaattctgcttcccgtagat

SEQ ID NO: 246087 - DNA, 23 bp, Artificial sequence
  SiRNA target sequence
attaattctgcttcccgtagata

SEQ ID NO: 246088 - DNA, 23 bp, Artificial sequence
  SiRNA target sequence
ttaattctgcttcccgtagataa

SEQ ID NO: 246089 - DNA, 23 bp, Artificial sequence
  SiRNA target sequence
taattctgcttcccgtagataaa

SEQ ID NO: 246090 - DNA, 23 bp, Artificial sequence
  SiRNA target sequence
aattctgcttcccgtagataaag

SEQ ID NO: 246091 - DNA, 23 bp, Artificial sequence
  SiRNA target sequence
attctgcttcccgtagataaaga

SEQ ID NO: 246092 - DNA, 23 bp, Artificial sequence
  SiRNA target sequence
ttctgcttcccgtagataaagaa

SEQ ID NO: 246093 - DNA, 23 bp, Artificial sequence
  SiRNA target sequence
tctgcttcccgtagataaagaat

SEQ ID NO: 246094 - DNA, 23 bp, Artificial sequence
  SiRNA target sequence
ctgcttcccgtagataaagaatt

SEQ ID NO: 246095 - DNA, 23 bp, Artificial sequence
  SiRNA target sequence
tgcttcccgtagataaagaattt

SEQ ID NO: 246096 - DNA, 23 bp, Artificial sequence
  SiRNA target sequence
gcttcccgtagataaagaatttt

SEQ ID NO: 246097 - DNA, 23 bp, Artificial sequence
  SiRNA target sequence
cttcccgtagataaagaattttt

SEQ ID NO: 246098 - DNA, 23 bp, Artificial sequence
  SiRNA target sequence
ttcccgtagataaagaatttttt

SEQ ID NO: 246099 - DNA, 23 bp, Artificial sequence
  SiRNA target sequence
tcccgtagataaagaatttttta

SEQ ID NO: 246100 - DNA, 23 bp, Artificial sequence
  SiRNA target sequence
cccgtagataaagaattttttaa

SEQ ID NO: 246101 - DNA, 23 bp, Artificial sequence
  SiRNA target sequence
ccgtagataaagaattttttaag

SEQ ID NO: 246102 - DNA, 23 bp, Artificial sequence
  SiRNA target sequence
cgtagataaagaattttttaagg

SEQ ID NO: 246103 - DNA, 23 bp, Artificial sequence
  SiRNA target sequence
gtagataaagaattttttaagga

SEQ ID NO: 246104 - DNA, 23 bp, Artificial sequence
  SiRNA target sequence
tagataaagaattttttaaggac

SEQ ID NO: 246105 - DNA, 23 bp, Artificial sequence
  SiRNA target sequence
agataaagaattttttaaggaca

SEQ ID NO: 246106 - DNA, 23 bp, Artificial sequence
  SiRNA target sequence
gataaagaattttttaaggacat

SEQ ID NO: 246107 - DNA, 23 bp, Artificial sequence
  SiRNA target sequence
ataaagaattttttaaggacata

SEQ ID NO: 246108 - DNA, 23 bp, Artificial sequence
  SiRNA target sequence
taaagaattttttaaggacatat

SEQ ID NO: 246109 - DNA, 23 bp, Artificial sequence
  SiRNA target sequence
aaagaattttttaaggacatatc

SEQ ID NO: 246110 - DNA, 23 bp, Artificial sequence
  SiRNA target sequence
aagaattttttaaggacatatca

SEQ ID NO: 246111 - DNA, 23 bp, Artificial sequence
  SiRNA target sequence
agaattttttaaggacatatcaa

SEQ ID NO: 246112 - DNA, 23 bp, Artificial sequence
  SiRNA target sequence
gaattttttaaggacatatcaat

SEQ ID NO: 246113 - DNA, 23 bp, Artificial sequence
  SiRNA target sequence
aattttttaaggacatatcaata

SEQ ID NO: 246114 - DNA, 23 bp, Artificial sequence
  SiRNA target sequence
attttttaaggacatatcaataa

SEQ ID NO: 246115 - DNA, 23 bp, Artificial sequence
  SiRNA target sequence
ttttttaaggacatatcaataaa

SEQ ID NO: 246116 - DNA, 23 bp, Artificial sequence
  SiRNA target sequence
tttttaaggacatatcaataaat

SEQ ID NO: 246117 - DNA, 23 bp, Artificial sequence
  SiRNA target sequence
ttttaaggacatatcaataaatc

SEQ ID NO: 246118 - DNA, 23 bp, Artificial sequence
  SiRNA target sequence
tttaaggacatatcaataaatcc

SEQ ID NO: 246119 - DNA, 23 bp, Artificial sequence
  SiRNA target sequence
ttaaggacatatcaataaatcct

SEQ ID NO: 246120 - DNA, 23 bp, Artificial sequence
  SiRNA target sequence
taaggacatatcaataaatcctg

SEQ ID NO: 246121 - DNA, 23 bp, Artificial sequence
  SiRNA target sequence
aaggacatatcaataaatcctgc

SEQ ID NO: 246122 - DNA, 23 bp, Artificial sequence
  SiRNA target sequence
aggacatatcaataaatcctgca

SEQ ID NO: 246123 - DNA, 23 bp, Artificial sequence
  SiRNA target sequence
ggacatatcaataaatcctgcat

SEQ ID NO: 246124 - DNA, 23 bp, Artificial sequence
  SiRNA target sequence
gacatatcaataaatcctgcatt

SEQ ID NO: 246125 - DNA, 23 bp, Artificial sequence
  SiRNA target sequence
acatatcaataaatcctgcatta

SEQ ID NO: 246126 - DNA, 23 bp, Artificial sequence
  SiRNA target sequence
catatcaataaatcctgcattaa

SEQ ID NO: 246127 - DNA, 23 bp, Artificial sequence
  SiRNA target sequence
atatcaataaatcctgcattaat

SEQ ID NO: 246128 - DNA, 23 bp, Artificial sequence
  SiRNA target sequence
tatcaataaatcctgcattaata

SEQ ID NO: 246129 - DNA, 23 bp, Artificial sequence
  SiRNA target sequence
atcaataaatcctgcattaatag

SEQ ID NO: 246130 - DNA, 23 bp, Artificial sequence
  SiRNA target sequence
tcaataaatcctgcattaatagc

SEQ ID NO: 246131 - DNA, 23 bp, Artificial sequence
  SiRNA target sequence
caataaatcctgcattaatagca

SEQ ID NO: 246132 - DNA, 23 bp, Artificial sequence
  SiRNA target sequence
aataaatcctgcattaatagcat

SEQ ID NO: 246133 - DNA, 23 bp, Artificial sequence
  SiRNA target sequence
ataaatcctgcattaatagcata

SEQ ID NO: 246134 - DNA, 23 bp, Artificial sequence
  SiRNA target sequence
taaatcctgcattaatagcatag

SEQ ID NO: 246135 - DNA, 23 bp, Artificial sequence
  SiRNA target sequence
aaatcctgcattaatagcataga

SEQ ID NO: 246136 - DNA, 23 bp, Artificial sequence
  SiRNA target sequence
aatcctgcattaatagcatagat

SEQ ID NO: 246137 - DNA, 23 bp, Artificial sequence
  SiRNA target sequence
atcctgcattaatagcatagatt

SEQ ID NO: 246138 - DNA, 23 bp, Artificial sequence
  SiRNA target sequence
tcctgcattaatagcatagatta

SEQ ID NO: 246139 - DNA, 23 bp, Artificial sequence
  SiRNA target sequence
cctgcattaatagcatagattaa

SEQ ID NO: 246140 - DNA, 23 bp, Artificial sequence
  SiRNA target sequence
ctgcattaatagcatagattaat

SEQ ID NO: 246141 - DNA, 23 bp, Artificial sequence
  SiRNA target sequence
tgcattaatagcatagattaatg

SEQ ID NO: 246142 - DNA, 23 bp, Artificial sequence
  SiRNA target sequence
gcattaatagcatagattaatgc

SEQ ID NO: 246143 - DNA, 23 bp, Artificial sequence
  SiRNA target sequence
cattaatagcatagattaatgcc

SEQ ID NO: 246144 - DNA, 23 bp, Artificial sequence
  SiRNA target sequence
attaatagcatagattaatgccg

SEQ ID NO: 246145 - DNA, 23 bp, Artificial sequence
  SiRNA target sequence
ttaatagcatagattaatgccgc

SEQ ID NO: 246146 - DNA, 23 bp, Artificial sequence
  SiRNA target sequence
taatagcatagattaatgccgct

SEQ ID NO: 246147 - DNA, 23 bp, Artificial sequence
  SiRNA target sequence
aatagcatagattaatgccgctg

SEQ ID NO: 246148 - DNA, 23 bp, Artificial sequence
  SiRNA target sequence
atagcatagattaatgccgctgc

SEQ ID NO: 246149 - DNA, 23 bp, Artificial sequence
  SiRNA target sequence
tagcatagattaatgccgctgca

SEQ ID NO: 246150 - DNA, 23 bp, Artificial sequence
  SiRNA target sequence
agcatagattaatgccgctgcac

SEQ ID NO: 246151 - DNA, 23 bp, Artificial sequence
  SiRNA target sequence
gcatagattaatgccgctgcaca

SEQ ID NO: 246152 - DNA, 23 bp, Artificial sequence
  SiRNA target sequence
catagattaatgccgctgcacac

SEQ ID NO: 246153 - DNA, 23 bp, Artificial sequence
  SiRNA target sequence
atagattaatgccgctgcacaca

SEQ ID NO: 246154 - DNA, 23 bp, Artificial sequence
  SiRNA target sequence
tagattaatgccgctgcacacat

SEQ ID NO: 246155 - DNA, 23 bp, Artificial sequence
  SiRNA target sequence
agattaatgccgctgcacacata

SEQ ID NO: 246156 - DNA, 23 bp, Artificial sequence
  SiRNA target sequence
gattaatgccgctgcacacatat

SEQ ID NO: 246157 - DNA, 23 bp, Artificial sequence
  SiRNA target sequence
attaatgccgctgcacacatatt

SEQ ID NO: 246158 - DNA, 23 bp, Artificial sequence
  SiRNA target sequence
ttaatgccgctgcacacatattt

SEQ ID NO: 246159 - DNA, 23 bp, Artificial sequence
  SiRNA target sequence
taatgccgctgcacacatatttc

SEQ ID NO: 246160 - DNA, 23 bp, Artificial sequence
  SiRNA target sequence
aatgccgctgcacacatatttct

SEQ ID NO: 246161 - DNA, 23 bp, Artificial sequence
  SiRNA target sequence
atgccgctgcacacatatttctt

SEQ ID NO: 246162 - DNA, 23 bp, Artificial sequence
  SiRNA target sequence
tgccgctgcacacatatttctta

SEQ ID NO: 246163 - DNA, 23 bp, Artificial sequence
  SiRNA target sequence
gccgctgcacacatatttcttaa

SEQ ID NO: 246164 - DNA, 23 bp, Artificial sequence
  SiRNA target sequence
ccgctgcacacatatttcttaaa

SEQ ID NO: 246165 - DNA, 23 bp, Artificial sequence
  SiRNA target sequence
cgctgcacacatatttcttaaaa

SEQ ID NO: 246166 - DNA, 23 bp, Artificial sequence
  SiRNA target sequence
gctgcacacatatttcttaaaaa

SEQ ID NO: 246167 - DNA, 23 bp, Artificial sequence
  SiRNA target sequence
ctgcacacatatttcttaaaaat

SEQ ID NO: 246168 - DNA, 23 bp, Artificial sequence
  SiRNA target sequence
tgcacacatatttcttaaaaatt

SEQ ID NO: 246169 - DNA, 23 bp, Artificial sequence
  SiRNA target sequence
gcacacatatttcttaaaaattt

SEQ ID NO: 246170 - DNA, 23 bp, Artificial sequence
  SiRNA target sequence
cacacatatttcttaaaaatttg

SEQ ID NO: 246171 - DNA, 23 bp, Artificial sequence
  SiRNA target sequence
acacatatttcttaaaaatttgg

SEQ ID NO: 246172 - DNA, 23 bp, Artificial sequence
  SiRNA target sequence
cacatatttcttaaaaatttgga

SEQ ID NO: 246173 - DNA, 23 bp, Artificial sequence
  SiRNA target sequence
acatatttcttaaaaatttggat

SEQ ID NO: 246174 - DNA, 23 bp, Artificial sequence
  SiRNA target sequence
catatttcttaaaaatttggatt

SEQ ID NO: 246175 - DNA, 23 bp, Artificial sequence
  SiRNA target sequence
atatttcttaaaaatttggattg

SEQ ID NO: 246176 - DNA, 23 bp, Artificial sequence
  SiRNA target sequence
tatttcttaaaaatttggattgt

SEQ ID NO: 246177 - DNA, 23 bp, Artificial sequence
  SiRNA target sequence
atttcttaaaaatttggattgta

SEQ ID NO: 246178 - DNA, 23 bp, Artificial sequence
  SiRNA target sequence
tttcttaaaaatttggattgtaa

SEQ ID NO: 246179 - DNA, 23 bp, Artificial sequence
  SiRNA target sequence
ttcttaaaaatttggattgtaaa

SEQ ID NO: 246180 - DNA, 23 bp, Artificial sequence
  SiRNA target sequence
tcttaaaaatttggattgtaaaa

SEQ ID NO: 246181 - DNA, 23 bp, Artificial sequence
  SiRNA target sequence
cttaaaaatttggattgtaaaag

SEQ ID NO: 246182 - DNA, 23 bp, Artificial sequence
  SiRNA target sequence
ttaaaaatttggattgtaaaaga

SEQ ID NO: 246183 - DNA, 23 bp, Artificial sequence
  SiRNA target sequence
taaaaatttggattgtaaaagat

SEQ ID NO: 246184 - DNA, 23 bp, Artificial sequence
  SiRNA target sequence
aaaaatttggattgtaaaagatc

SEQ ID NO: 246185 - DNA, 23 bp, Artificial sequence
  SiRNA target sequence
aaaatttggattgtaaaagatca

SEQ ID NO: 246186 - DNA, 23 bp, Artificial sequence
  SiRNA target sequence
aaatttggattgtaaaagatcaa

SEQ ID NO: 246187 - DNA, 23 bp, Artificial sequence
  SiRNA target sequence
aatttggattgtaaaagatcaaa

SEQ ID NO: 246188 - DNA, 23 bp, Artificial sequence
  SiRNA target sequence
atttggattgtaaaagatcaaac

SEQ ID NO: 246189 - DNA, 23 bp, Artificial sequence
  SiRNA target sequence
tttggattgtaaaagatcaaacg

SEQ ID NO: 246190 - DNA, 23 bp, Artificial sequence
  SiRNA target sequence
ttggattgtaaaagatcaaacga

SEQ ID NO: 246191 - DNA, 23 bp, Artificial sequence
  SiRNA target sequence
tggattgtaaaagatcaaacgag

SEQ ID NO: 246192 - DNA, 23 bp, Artificial sequence
  SiRNA target sequence
ggattgtaaaagatcaaacgagg

SEQ ID NO: 246193 - DNA, 23 bp, Artificial sequence
  SiRNA target sequence
gattgtaaaagatcaaacgagga

SEQ ID NO: 246194 - DNA, 23 bp, Artificial sequence
  SiRNA target sequence
attgtaaaagatcaaacgaggat

SEQ ID NO: 246195 - DNA, 23 bp, Artificial sequence
  SiRNA target sequence
ttgtaaaagatcaaacgaggatg

SEQ ID NO: 246196 - DNA, 23 bp, Artificial sequence
  SiRNA target sequence
tgtaaaagatcaaacgaggatgt

SEQ ID NO: 246197 - DNA, 23 bp, Artificial sequence
  SiRNA target sequence
gtaaaagatcaaacgaggatgtc

SEQ ID NO: 246198 - DNA, 23 bp, Artificial sequence
  SiRNA target sequence
taaaagatcaaacgaggatgtcg

SEQ ID NO: 246199 - DNA, 23 bp, Artificial sequence
  SiRNA target sequence
aaaagatcaaacgaggatgtcgt

SEQ ID NO: 246200 - DNA, 23 bp, Artificial sequence
  SiRNA target sequence
aaagatcaaacgaggatgtcgtt

SEQ ID NO: 246201 - DNA, 23 bp, Artificial sequence
  SiRNA target sequence
aagatcaaacgaggatgtcgttt

SEQ ID NO: 246202 - DNA, 23 bp, Artificial sequence
  SiRNA target sequence
agatcaaacgaggatgtcgtttt

SEQ ID NO: 246203 - DNA, 23 bp, Artificial sequence
  SiRNA target sequence
gatcaaacgaggatgtcgttttg

SEQ ID NO: 246204 - DNA, 23 bp, Artificial sequence
  SiRNA target sequence
atcaaacgaggatgtcgttttgt

SEQ ID NO: 246205 - DNA, 23 bp, Artificial sequence
  SiRNA target sequence
tcaaacgaggatgtcgttttgtc

SEQ ID NO: 246206 - DNA, 23 bp, Artificial sequence
  SiRNA target sequence
caaacgaggatgtcgttttgtct

SEQ ID NO: 246207 - DNA, 23 bp, Artificial sequence
  SiRNA target sequence
aaacgaggatgtcgttttgtctt

SEQ ID NO: 246208 - DNA, 23 bp, Artificial sequence
  SiRNA target sequence
aacgaggatgtcgttttgtcttc

SEQ ID NO: 246209 - DNA, 23 bp, Artificial sequence
  SiRNA target sequence
acgaggatgtcgttttgtcttct

SEQ ID NO: 246210 - DNA, 23 bp, Artificial sequence
  SiRNA target sequence
cgaggatgtcgttttgtcttctt

SEQ ID NO: 246211 - DNA, 23 bp, Artificial sequence
  SiRNA target sequence
gaggatgtcgttttgtcttcttc

SEQ ID NO: 246212 - DNA, 23 bp, Artificial sequence
  SiRNA target sequence
aggatgtcgttttgtcttcttct

SEQ ID NO: 246213 - DNA, 23 bp, Artificial sequence
  SiRNA target sequence
ggatgtcgttttgtcttcttctt

SEQ ID NO: 246214 - DNA, 23 bp, Artificial sequence
  SiRNA target sequence
gatgtcgttttgtcttcttcttt

SEQ ID NO: 246215 - DNA, 23 bp, Artificial sequence
  SiRNA target sequence
atgtcgttttgtcttcttcttta

SEQ ID NO: 246216 - DNA, 23 bp, Artificial sequence
  SiRNA target sequence
tgtcgttttgtcttcttctttat

SEQ ID NO: 246217 - DNA, 23 bp, Artificial sequence
  SiRNA target sequence
gtcgttttgtcttcttctttatt

SEQ ID NO: 246218 - DNA, 23 bp, Artificial sequence
  SiRNA target sequence
tcgttttgtcttcttctttattt

SEQ ID NO: 246219 - DNA, 23 bp, Artificial sequence
  SiRNA target sequence
cgttttgtcttcttctttattta

SEQ ID NO: 246220 - DNA, 23 bp, Artificial sequence
  SiRNA target sequence
gttttgtcttcttctttatttat

SEQ ID NO: 246221 - DNA, 23 bp, Artificial sequence
  SiRNA target sequence
ttttgtcttcttctttatttata

SEQ ID NO: 246222 - DNA, 23 bp, Artificial sequence
  SiRNA target sequence
tttgtcttcttctttatttatag

SEQ ID NO: 246223 - DNA, 23 bp, Artificial sequence
  SiRNA target sequence
ttgtcttcttctttatttatagt

SEQ ID NO: 246224 - DNA, 23 bp, Artificial sequence
  SiRNA target sequence
tgtcttcttctttatttatagtt

SEQ ID NO: 246225 - DNA, 23 bp, Artificial sequence
  SiRNA target sequence
gtcttcttctttatttatagttt

SEQ ID NO: 246226 - DNA, 23 bp, Artificial sequence
  SiRNA target sequence
tcttcttctttatttatagtttc

SEQ ID NO: 246227 - DNA, 23 bp, Artificial sequence
  SiRNA target sequence
cttcttctttatttatagtttcc

SEQ ID NO: 246228 - DNA, 23 bp, Artificial sequence
  SiRNA target sequence
ttcttctttatttatagtttcct

SEQ ID NO: 246229 - DNA, 23 bp, Artificial sequence
  SiRNA target sequence
tcttctttatttatagtttcctt

SEQ ID NO: 246230 - DNA, 23 bp, Artificial sequence
  SiRNA target sequence
cttctttatttatagtttccttt

SEQ ID NO: 246231 - DNA, 23 bp, Artificial sequence
  SiRNA target sequence
ttctttatttatagtttccttta

SEQ ID NO: 246232 - DNA, 23 bp, Artificial sequence
  SiRNA target sequence
tctttatttatagtttcctttat

SEQ ID NO: 246233 - DNA, 23 bp, Artificial sequence
  SiRNA target sequence
ctttatttatagtttcctttatt

SEQ ID NO: 246234 - DNA, 23 bp, Artificial sequence
  SiRNA target sequence
tttatttatagtttcctttattt

SEQ ID NO: 246235 - DNA, 23 bp, Artificial sequence
  SiRNA target sequence
ttatttatagtttcctttatttc

SEQ ID NO: 246236 - DNA, 23 bp, Artificial sequence
  SiRNA target sequence
tatttatagtttcctttatttct

SEQ ID NO: 246237 - DNA, 23 bp, Artificial sequence
  SiRNA target sequence
atttatagtttcctttatttctt

SEQ ID NO: 246238 - DNA, 23 bp, Artificial sequence
  SiRNA target sequence
tttatagtttcctttatttcttt

SEQ ID NO: 246239 - DNA, 23 bp, Artificial sequence
  SiRNA target sequence
ttatagtttcctttatttcttta

SEQ ID NO: 246240 - DNA, 23 bp, Artificial sequence
  SiRNA target sequence
tatagtttcctttatttctttag

SEQ ID NO: 246241 - DNA, 23 bp, Artificial sequence
  SiRNA target sequence
atagtttcctttatttctttagt

SEQ ID NO: 246242 - DNA, 23 bp, Artificial sequence
  SiRNA target sequence
tagtttcctttatttctttagtt

SEQ ID NO: 246243 - DNA, 23 bp, Artificial sequence
  SiRNA target sequence
agtttcctttatttctttagttt

SEQ ID NO: 246244 - DNA, 23 bp, Artificial sequence
  SiRNA target sequence
gtttcctttatttctttagtttt

SEQ ID NO: 246245 - DNA, 23 bp, Artificial sequence
  SiRNA target sequence
tttcctttatttctttagtttta

SEQ ID NO: 246246 - DNA, 23 bp, Artificial sequence
  SiRNA target sequence
ttcctttatttctttagttttaa

SEQ ID NO: 246247 - DNA, 23 bp, Artificial sequence
  SiRNA target sequence
tcctttatttctttagttttaag

SEQ ID NO: 246248 - DNA, 23 bp, Artificial sequence
  SiRNA target sequence
cctttatttctttagttttaaga

SEQ ID NO: 246249 - DNA, 23 bp, Artificial sequence
  SiRNA target sequence
ctttatttctttagttttaagag

SEQ ID NO: 246250 - DNA, 23 bp, Artificial sequence
  SiRNA target sequence
tttatttctttagttttaagagg

SEQ ID NO: 246251 - DNA, 23 bp, Artificial sequence
  SiRNA target sequence
ttatttctttagttttaagagga

SEQ ID NO: 246252 - DNA, 23 bp, Artificial sequence
  SiRNA target sequence
tatttctttagttttaagaggaa

SEQ ID NO: 246253 - DNA, 23 bp, Artificial sequence
  SiRNA target sequence
atttctttagttttaagaggaat

SEQ ID NO: 246254 - DNA, 23 bp, Artificial sequence
  SiRNA target sequence
tttctttagttttaagaggaata

SEQ ID NO: 246255 - DNA, 23 bp, Artificial sequence
  SiRNA target sequence
ttctttagttttaagaggaatat

SEQ ID NO: 246256 - DNA, 23 bp, Artificial sequence
  SiRNA target sequence
tctttagttttaagaggaatata

SEQ ID NO: 246257 - DNA, 23 bp, Artificial sequence
  SiRNA target sequence
ctttagttttaagaggaatataa

SEQ ID NO: 246258 - DNA, 23 bp, Artificial sequence
  SiRNA target sequence
tttagttttaagaggaatataac

SEQ ID NO: 246259 - DNA, 23 bp, Artificial sequence
  SiRNA target sequence
ttagttttaagaggaatataact

SEQ ID NO: 246260 - DNA, 23 bp, Artificial sequence
  SiRNA target sequence
tagttttaagaggaatataactt

SEQ ID NO: 246261 - DNA, 23 bp, Artificial sequence
  SiRNA target sequence
agttttaagaggaatataacttt

SEQ ID NO: 246262 - DNA, 23 bp, Artificial sequence
  SiRNA target sequence
gttttaagaggaatataactttt

SEQ ID NO: 246263 - DNA, 23 bp, Artificial sequence
  SiRNA target sequence
ttttaagaggaatataacttttt

SEQ ID NO: 246264 - DNA, 23 bp, Artificial sequence
  SiRNA target sequence
tttaagaggaatataacttttta

SEQ ID NO: 246265 - DNA, 23 bp, Artificial sequence
  SiRNA target sequence
ttaagaggaatataactttttaa

SEQ ID NO: 246266 - DNA, 23 bp, Artificial sequence
  SiRNA target sequence
taagaggaatataactttttaaa

SEQ ID NO: 246267 - DNA, 23 bp, Artificial sequence
  SiRNA target sequence
aagaggaatataactttttaaaa

SEQ ID NO: 246268 - DNA, 23 bp, Artificial sequence
  SiRNA target sequence
agaggaatataactttttaaaaa

SEQ ID NO: 246269 - DNA, 23 bp, Artificial sequence
  SiRNA target sequence
gaggaatataactttttaaaaag

SEQ ID NO: 246270 - DNA, 23 bp, Artificial sequence
  SiRNA target sequence
aggaatataactttttaaaaagt

SEQ ID NO: 246271 - DNA, 23 bp, Artificial sequence
  SiRNA target sequence
ggaatataactttttaaaaagta

SEQ ID NO: 246272 - DNA, 23 bp, Artificial sequence
  SiRNA target sequence
gaatataactttttaaaaagtaa

SEQ ID NO: 246273 - DNA, 23 bp, Artificial sequence
  SiRNA target sequence
aatataactttttaaaaagtaaa

SEQ ID NO: 246274 - DNA, 23 bp, Artificial sequence
  SiRNA target sequence
atataactttttaaaaagtaaat

SEQ ID NO: 246275 - DNA, 23 bp, Artificial sequence
  SiRNA target sequence
tataactttttaaaaagtaaatt

SEQ ID NO: 246276 - DNA, 23 bp, Artificial sequence
  SiRNA target sequence
ataactttttaaaaagtaaatta

SEQ ID NO: 246277 - DNA, 23 bp, Artificial sequence
  SiRNA target sequence
taactttttaaaaagtaaattaa

SEQ ID NO: 246278 - DNA, 23 bp, Artificial sequence
  SiRNA target sequence
aactttttaaaaagtaaattaat

SEQ ID NO: 246279 - DNA, 23 bp, Artificial sequence
  SiRNA target sequence
actttttaaaaagtaaattaatg

SEQ ID NO: 246280 - DNA, 23 bp, Artificial sequence
  SiRNA target sequence
ctttttaaaaagtaaattaatgt

SEQ ID NO: 246281 - DNA, 23 bp, Artificial sequence
  SiRNA target sequence
tttttaaaaagtaaattaatgta

SEQ ID NO: 246282 - DNA, 23 bp, Artificial sequence
  SiRNA target sequence
ttttaaaaagtaaattaatgtag

SEQ ID NO: 246283 - DNA, 23 bp, Artificial sequence
  SiRNA target sequence
tttaaaaagtaaattaatgtagt

SEQ ID NO: 246284 - DNA, 23 bp, Artificial sequence
  SiRNA target sequence
ttaaaaagtaaattaatgtagtt

SEQ ID NO: 246285 - DNA, 23 bp, Artificial sequence
  SiRNA target sequence
taaaaagtaaattaatgtagtta

SEQ ID NO: 246286 - DNA, 23 bp, Artificial sequence
  SiRNA target sequence
aaaaagtaaattaatgtagttac

SEQ ID NO: 246287 - DNA, 23 bp, Artificial sequence
  SiRNA target sequence
aaaagtaaattaatgtagttaca

SEQ ID NO: 246288 - DNA, 23 bp, Artificial sequence
  SiRNA target sequence
aaagtaaattaatgtagttacaa

SEQ ID NO: 246289 - DNA, 23 bp, Artificial sequence
  SiRNA target sequence
aagtaaattaatgtagttacaaa

SEQ ID NO: 246290 - DNA, 23 bp, Artificial sequence
  SiRNA target sequence
agtaaattaatgtagttacaaaa

SEQ ID NO: 246291 - DNA, 23 bp, Artificial sequence
  SiRNA target sequence
gtaaattaatgtagttacaaaag

SEQ ID NO: 246292 - DNA, 23 bp, Artificial sequence
  SiRNA target sequence
taaattaatgtagttacaaaaga

SEQ ID NO: 246293 - DNA, 23 bp, Artificial sequence
  SiRNA target sequence
aaattaatgtagttacaaaagac

SEQ ID NO: 246294 - DNA, 23 bp, Artificial sequence
  SiRNA target sequence
aattaatgtagttacaaaagaca

SEQ ID NO: 246295 - DNA, 23 bp, Artificial sequence
  SiRNA target sequence
attaatgtagttacaaaagacaa

SEQ ID NO: 246296 - DNA, 23 bp, Artificial sequence
  SiRNA target sequence
ttaatgtagttacaaaagacaag

SEQ ID NO: 246297 - DNA, 23 bp, Artificial sequence
  SiRNA target sequence
taatgtagttacaaaagacaaga

SEQ ID NO: 246298 - DNA, 23 bp, Artificial sequence
  SiRNA target sequence
aatgtagttacaaaagacaagat

SEQ ID NO: 246299 - DNA, 23 bp, Artificial sequence
  SiRNA target sequence
atgtagttacaaaagacaagatc

SEQ ID NO: 246300 - DNA, 23 bp, Artificial sequence
  SiRNA target sequence
tgtagttacaaaagacaagatca

SEQ ID NO: 246301 - DNA, 23 bp, Artificial sequence
  SiRNA target sequence
gtagttacaaaagacaagatcaa

SEQ ID NO: 246302 - DNA, 23 bp, Artificial sequence
  SiRNA target sequence
tagttacaaaagacaagatcaaa

SEQ ID NO: 246303 - DNA, 23 bp, Artificial sequence
  SiRNA target sequence
agttacaaaagacaagatcaaaa

SEQ ID NO: 246304 - DNA, 23 bp, Artificial sequence
  SiRNA target sequence
gttacaaaagacaagatcaaaaa

SEQ ID NO: 246305 - DNA, 23 bp, Artificial sequence
  SiRNA target sequence
ttacaaaagacaagatcaaaaaa

SEQ ID NO: 246306 - DNA, 23 bp, Artificial sequence
  SiRNA target sequence
tacaaaagacaagatcaaaaaaa

SEQ ID NO: 246307 - DNA, 23 bp, Artificial sequence
  SiRNA target sequence
acaaaagacaagatcaaaaaaaa

SEQ ID NO: 246308 - DNA, 23 bp, Artificial sequence
  SiRNA target sequence
caaaagacaagatcaaaaaaaac

SEQ ID NO: 246309 - DNA, 23 bp, Artificial sequence
  SiRNA target sequence
aaaagacaagatcaaaaaaaaca

SEQ ID NO: 246310 - DNA, 23 bp, Artificial sequence
  SiRNA target sequence
aaagacaagatcaaaaaaaacaa

SEQ ID NO: 246311 - DNA, 23 bp, Artificial sequence
  SiRNA target sequence
aagacaagatcaaaaaaaacaaa

SEQ ID NO: 246312 - DNA, 23 bp, Artificial sequence
  SiRNA target sequence
agacaagatcaaaaaaaacaaac

SEQ ID NO: 246313 - DNA, 23 bp, Artificial sequence
  SiRNA target sequence
gacaagatcaaaaaaaacaaact

SEQ ID NO: 246314 - DNA, 23 bp, Artificial sequence
  SiRNA target sequence
acaagatcaaaaaaaacaaacta

SEQ ID NO: 246315 - DNA, 23 bp, Artificial sequence
  SiRNA target sequence
caagatcaaaaaaaacaaactac

SEQ ID NO: 246316 - DNA, 23 bp, Artificial sequence
  SiRNA target sequence
aagatcaaaaaaaacaaactact

SEQ ID NO: 246317 - DNA, 23 bp, Artificial sequence
  SiRNA target sequence
agatcaaaaaaaacaaactacta

SEQ ID NO: 246318 - DNA, 23 bp, Artificial sequence
  SiRNA target sequence
gatcaaaaaaaacaaactactac

SEQ ID NO: 246319 - DNA, 23 bp, Artificial sequence
  SiRNA target sequence
atcaaaaaaaacaaactactacc

SEQ ID NO: 246320 - DNA, 23 bp, Artificial sequence
  SiRNA target sequence
tcaaaaaaaacaaactactaccg

SEQ ID NO: 246321 - DNA, 23 bp, Artificial sequence
  SiRNA target sequence
caaaaaaaacaaactactaccgt

SEQ ID NO: 246322 - DNA, 23 bp, Artificial sequence
  SiRNA target sequence
aaaaaaaacaaactactaccgtc

SEQ ID NO: 246323 - DNA, 23 bp, Artificial sequence
  SiRNA target sequence
aaaaaaacaaactactaccgtca

SEQ ID NO: 246324 - DNA, 23 bp, Artificial sequence
  SiRNA target sequence
aaaaaacaaactactaccgtcaa

SEQ ID NO: 246325 - DNA, 23 bp, Artificial sequence
  SiRNA target sequence
aaaaacaaactactaccgtcaat

SEQ ID NO: 246326 - DNA, 23 bp, Artificial sequence
  SiRNA target sequence
aaaacaaactactaccgtcaatt

SEQ ID NO: 246327 - DNA, 23 bp, Artificial sequence
  SiRNA target sequence
aaacaaactactaccgtcaattt

SEQ ID NO: 246328 - DNA, 23 bp, Artificial sequence
  SiRNA target sequence
aacaaactactaccgtcaatttt

SEQ ID NO: 246329 - DNA, 23 bp, Artificial sequence
  SiRNA target sequence
acaaactactaccgtcaatttta

SEQ ID NO: 246330 - DNA, 23 bp, Artificial sequence
  SiRNA target sequence
caaactactaccgtcaattttat

SEQ ID NO: 246331 - DNA, 23 bp, Artificial sequence
  SiRNA target sequence
aaactactaccgtcaattttatc

SEQ ID NO: 246332 - DNA, 23 bp, Artificial sequence
  SiRNA target sequence
aactactaccgtcaattttatca

SEQ ID NO: 246333 - DNA, 23 bp, Artificial sequence
  SiRNA target sequence
actactaccgtcaattttatcat

SEQ ID NO: 246334 - DNA, 23 bp, Artificial sequence
  SiRNA target sequence
ctactaccgtcaattttatcatg

SEQ ID NO: 246335 - DNA, 23 bp, Artificial sequence
  SiRNA target sequence
tactaccgtcaattttatcatgc

SEQ ID NO: 246336 - DNA, 23 bp, Artificial sequence
  SiRNA target sequence
actaccgtcaattttatcatgca

SEQ ID NO: 246337 - DNA, 23 bp, Artificial sequence
  SiRNA target sequence
ctaccgtcaattttatcatgcaa

SEQ ID NO: 246338 - DNA, 23 bp, Artificial sequence
  SiRNA target sequence
taccgtcaattttatcatgcaaa

SEQ ID NO: 246339 - DNA, 23 bp, Artificial sequence
  SiRNA target sequence
accgtcaattttatcatgcaaac

SEQ ID NO: 246340 - DNA, 23 bp, Artificial sequence
  SiRNA target sequence
ccgtcaattttatcatgcaaacc

SEQ ID NO: 246341 - DNA, 23 bp, Artificial sequence
  SiRNA target sequence
cgtcaattttatcatgcaaacct

SEQ ID NO: 246342 - DNA, 23 bp, Artificial sequence
  SiRNA target sequence
gtcaattttatcatgcaaacctg

SEQ ID NO: 246343 - DNA, 23 bp, Artificial sequence
  SiRNA target sequence
tcaattttatcatgcaaacctgc

SEQ ID NO: 246344 - DNA, 23 bp, Artificial sequence
  SiRNA target sequence
caattttatcatgcaaacctgca

SEQ ID NO: 246345 - DNA, 23 bp, Artificial sequence
  SiRNA target sequence
aattttatcatgcaaacctgcag

SEQ ID NO: 246346 - DNA, 23 bp, Artificial sequence
  SiRNA target sequence
attttatcatgcaaacctgcagg

SEQ ID NO: 246347 - DNA, 23 bp, Artificial sequence
  SiRNA target sequence
ttttatcatgcaaacctgcagga

SEQ ID NO: 246348 - DNA, 23 bp, Artificial sequence
  SiRNA target sequence
tttatcatgcaaacctgcaggaa

SEQ ID NO: 246349 - DNA, 23 bp, Artificial sequence
  SiRNA target sequence
ttatcatgcaaacctgcaggaag

SEQ ID NO: 246350 - DNA, 23 bp, Artificial sequence
  SiRNA target sequence
tatcatgcaaacctgcaggaagt

SEQ ID NO: 246351 - DNA, 23 bp, Artificial sequence
  SiRNA target sequence
atcatgcaaacctgcaggaagta

SEQ ID NO: 246352 - DNA, 23 bp, Artificial sequence
  SiRNA target sequence
tcatgcaaacctgcaggaagtat

SEQ ID NO: 246353 - DNA, 23 bp, Artificial sequence
  SiRNA target sequence
catgcaaacctgcaggaagtata

SEQ ID NO: 246354 - DNA, 23 bp, Artificial sequence
  SiRNA target sequence
atgcaaacctgcaggaagtatat

SEQ ID NO: 246355 - DNA, 23 bp, Artificial sequence
  SiRNA target sequence
tgcaaacctgcaggaagtatatt

SEQ ID NO: 246356 - DNA, 23 bp, Artificial sequence
  SiRNA target sequence
gcaaacctgcaggaagtatattt

SEQ ID NO: 246357 - DNA, 23 bp, Artificial sequence
  SiRNA target sequence
caaacctgcaggaagtatatttg

SEQ ID NO: 246358 - DNA, 23 bp, Artificial sequence
  SiRNA target sequence
aaacctgcaggaagtatatttgc

SEQ ID NO: 246359 - DNA, 23 bp, Artificial sequence
  SiRNA target sequence
aacctgcaggaagtatatttgct

SEQ ID NO: 246360 - DNA, 23 bp, Artificial sequence
  SiRNA target sequence
acctgcaggaagtatatttgcta

SEQ ID NO: 246361 - DNA, 23 bp, Artificial sequence
  SiRNA target sequence
cctgcaggaagtatatttgctaa

SEQ ID NO: 246362 - DNA, 23 bp, Artificial sequence
  SiRNA target sequence
ctgcaggaagtatatttgctaat

SEQ ID NO: 246363 - DNA, 23 bp, Artificial sequence
  SiRNA target sequence
tgcaggaagtatatttgctaatt

SEQ ID NO: 246364 - DNA, 23 bp, Artificial sequence
  SiRNA target sequence
gcaggaagtatatttgctaattc

SEQ ID NO: 246365 - DNA, 23 bp, Artificial sequence
  SiRNA target sequence
caggaagtatatttgctaattca

SEQ ID NO: 246366 - DNA, 23 bp, Artificial sequence
  SiRNA target sequence
aggaagtatatttgctaattcat

SEQ ID NO: 246367 - DNA, 23 bp, Artificial sequence
  SiRNA target sequence
ggaagtatatttgctaattcatc

SEQ ID NO: 246368 - DNA, 23 bp, Artificial sequence
  SiRNA target sequence
gaagtatatttgctaattcatct

SEQ ID NO: 246369 - DNA, 23 bp, Artificial sequence
  SiRNA target sequence
aagtatatttgctaattcatctt

SEQ ID NO: 246370 - DNA, 23 bp, Artificial sequence
  SiRNA target sequence
agtatatttgctaattcatcttt

SEQ ID NO: 246371 - DNA, 23 bp, Artificial sequence
  SiRNA target sequence
gtatatttgctaattcatctttt

SEQ ID NO: 246372 - DNA, 23 bp, Artificial sequence
  SiRNA target sequence
tatatttgctaattcatctttta

SEQ ID NO: 246373 - DNA, 23 bp, Artificial sequence
  SiRNA target sequence
atatttgctaattcatcttttat

SEQ ID NO: 246374 - DNA, 23 bp, Artificial sequence
  SiRNA target sequence
tatttgctaattcatcttttata

SEQ ID NO: 246375 - DNA, 23 bp, Artificial sequence
  SiRNA target sequence
atttgctaattcatcttttatat

SEQ ID NO: 246376 - DNA, 23 bp, Artificial sequence
  SiRNA target sequence
tttgctaattcatcttttatata

SEQ ID NO: 246377 - DNA, 23 bp, Artificial sequence
  SiRNA target sequence
ttgctaattcatcttttatataa

SEQ ID NO: 246378 - DNA, 23 bp, Artificial sequence
  SiRNA target sequence
tgctaattcatcttttatataaa

SEQ ID NO: 246379 - DNA, 23 bp, Artificial sequence
  SiRNA target sequence
gctaattcatcttttatataaat

SEQ ID NO: 246380 - DNA, 23 bp, Artificial sequence
  SiRNA target sequence
ctaattcatcttttatataaata

SEQ ID NO: 246381 - DNA, 23 bp, Artificial sequence
  SiRNA target sequence
taattcatcttttatataaataa

SEQ ID NO: 246382 - DNA, 23 bp, Artificial sequence
  SiRNA target sequence
aattcatcttttatataaataaa

SEQ ID NO: 246383 - DNA, 23 bp, Artificial sequence
  SiRNA target sequence
attcatcttttatataaataaaa

SEQ ID NO: 246384 - DNA, 23 bp, Artificial sequence
  SiRNA target sequence
ttcatcttttatataaataaaag

SEQ ID NO: 246385 - DNA, 23 bp, Artificial sequence
  SiRNA target sequence
tcatcttttatataaataaaagc

SEQ ID NO: 246386 - DNA, 23 bp, Artificial sequence
  SiRNA target sequence
catcttttatataaataaaagct

SEQ ID NO: 246387 - DNA, 23 bp, Artificial sequence
  SiRNA target sequence
atcttttatataaataaaagcta

SEQ ID NO: 246388 - DNA, 23 bp, Artificial sequence
  SiRNA target sequence
tcttttatataaataaaagctac

SEQ ID NO: 246389 - DNA, 23 bp, Artificial sequence
  SiRNA target sequence
cttttatataaataaaagctaca

SEQ ID NO: 246390 - DNA, 23 bp, Artificial sequence
  SiRNA target sequence
ttttatataaataaaagctacag

SEQ ID NO: 246391 - DNA, 23 bp, Artificial sequence
  SiRNA target sequence
tttatataaataaaagctacaga

SEQ ID NO: 246392 - DNA, 23 bp, Artificial sequence
  SiRNA target sequence
ttatataaataaaagctacagaa

SEQ ID NO: 246393 - DNA, 23 bp, Artificial sequence
  SiRNA target sequence
tatataaataaaagctacagaaa

SEQ ID NO: 246394 - DNA, 23 bp, Artificial sequence
  SiRNA target sequence
atataaataaaagctacagaaat

SEQ ID NO: 246395 - DNA, 23 bp, Artificial sequence
  SiRNA target sequence
tataaataaaagctacagaaata

SEQ ID NO: 246396 - DNA, 23 bp, Artificial sequence
  SiRNA target sequence
ataaataaaagctacagaaataa

SEQ ID NO: 246397 - DNA, 23 bp, Artificial sequence
  SiRNA target sequence
taaataaaagctacagaaataat

SEQ ID NO: 246398 - DNA, 23 bp, Artificial sequence
  SiRNA target sequence
aaataaaagctacagaaataatc

SEQ ID NO: 246399 - DNA, 23 bp, Artificial sequence
  SiRNA target sequence
aataaaagctacagaaataatca

SEQ ID NO: 246400 - DNA, 23 bp, Artificial sequence
  SiRNA target sequence
ataaaagctacagaaataatcat

SEQ ID NO: 246401 - DNA, 23 bp, Artificial sequence
  SiRNA target sequence
taaaagctacagaaataatcatt

SEQ ID NO: 246402 - DNA, 23 bp, Artificial sequence
  SiRNA target sequence
aaaagctacagaaataatcattg

SEQ ID NO: 246403 - DNA, 23 bp, Artificial sequence
  SiRNA target sequence
aaagctacagaaataatcattga

SEQ ID NO: 246404 - DNA, 23 bp, Artificial sequence
  SiRNA target sequence
aagctacagaaataatcattgaa

SEQ ID NO: 246405 - DNA, 23 bp, Artificial sequence
  SiRNA target sequence
agctacagaaataatcattgaaa

SEQ ID NO: 246406 - DNA, 23 bp, Artificial sequence
  SiRNA target sequence
gctacagaaataatcattgaaat

SEQ ID NO: 246407 - DNA, 23 bp, Artificial sequence
  SiRNA target sequence
ctacagaaataatcattgaaatg

SEQ ID NO: 246408 - DNA, 23 bp, Artificial sequence
  SiRNA target sequence
tacagaaataatcattgaaatgg

SEQ ID NO: 246409 - DNA, 23 bp, Artificial sequence
  SiRNA target sequence
acagaaataatcattgaaatggc

SEQ ID NO: 246410 - DNA, 23 bp, Artificial sequence
  SiRNA target sequence
cagaaataatcattgaaatggcg

SEQ ID NO: 246411 - DNA, 23 bp, Artificial sequence
  SiRNA target sequence
agaaataatcattgaaatggcgg

SEQ ID NO: 246412 - DNA, 23 bp, Artificial sequence
  SiRNA target sequence
gaaataatcattgaaatggcggt

SEQ ID NO: 246413 - DNA, 23 bp, Artificial sequence
  SiRNA target sequence
aaataatcattgaaatggcggtg

SEQ ID NO: 246414 - DNA, 23 bp, Artificial sequence
  SiRNA target sequence
aataatcattgaaatggcggtga

SEQ ID NO: 246415 - DNA, 23 bp, Artificial sequence
  SiRNA target sequence
ataatcattgaaatggcggtgat

SEQ ID NO: 246416 - DNA, 23 bp, Artificial sequence
  SiRNA target sequence
taatcattgaaatggcggtgatt

SEQ ID NO: 246417 - DNA, 23 bp, Artificial sequence
  SiRNA target sequence
aatcattgaaatggcggtgattg

SEQ ID NO: 246418 - DNA, 23 bp, Artificial sequence
  SiRNA target sequence
atcattgaaatggcggtgattgt

SEQ ID NO: 246419 - DNA, 23 bp, Artificial sequence
  SiRNA target sequence
tcattgaaatggcggtgattgtg

SEQ ID NO: 246420 - DNA, 23 bp, Artificial sequence
  SiRNA target sequence
cattgaaatggcggtgattgtgg

SEQ ID NO: 246421 - DNA, 23 bp, Artificial sequence
  SiRNA target sequence
attgaaatggcggtgattgtgga

SEQ ID NO: 246422 - DNA, 23 bp, Artificial sequence
  SiRNA target sequence
ttgaaatggcggtgattgtggaa

SEQ ID NO: 246423 - DNA, 23 bp, Artificial sequence
  SiRNA target sequence
tgaaatggcggtgattgtggaaa

SEQ ID NO: 246424 - DNA, 23 bp, Artificial sequence
  SiRNA target sequence
gaaatggcggtgattgtggaaaa

SEQ ID NO: 246425 - DNA, 23 bp, Artificial sequence
  SiRNA target sequence
aaatggcggtgattgtggaaaaa

SEQ ID NO: 246426 - DNA, 23 bp, Artificial sequence
  SiRNA target sequence
aatggcggtgattgtggaaaaat

SEQ ID NO: 246427 - DNA, 23 bp, Artificial sequence
  SiRNA target sequence
atggcggtgattgtggaaaaatt

SEQ ID NO: 246428 - DNA, 23 bp, Artificial sequence
  SiRNA target sequence
tggcggtgattgtggaaaaatta

SEQ ID NO: 246429 - DNA, 23 bp, Artificial sequence
  SiRNA target sequence
ggcggtgattgtggaaaaattag

SEQ ID NO: 246430 - DNA, 23 bp, Artificial sequence
  SiRNA target sequence
gcggtgattgtggaaaaattagg

SEQ ID NO: 246431 - DNA, 23 bp, Artificial sequence
  SiRNA target sequence
cggtgattgtggaaaaattagga

SEQ ID NO: 246432 - DNA, 23 bp, Artificial sequence
  SiRNA target sequence
ggtgattgtggaaaaattaggaa

SEQ ID NO: 246433 - DNA, 23 bp, Artificial sequence
  SiRNA target sequence
gtgattgtggaaaaattaggaac

SEQ ID NO: 246434 - DNA, 23 bp, Artificial sequence
  SiRNA target sequence
tgattgtggaaaaattaggaaca

SEQ ID NO: 246435 - DNA, 23 bp, Artificial sequence
  SiRNA target sequence
gattgtggaaaaattaggaacaa

SEQ ID NO: 246436 - DNA, 23 bp, Artificial sequence
  SiRNA target sequence
attgtggaaaaattaggaacaat

SEQ ID NO: 246437 - DNA, 23 bp, Artificial sequence
  SiRNA target sequence
ttgtggaaaaattaggaacaatt

SEQ ID NO: 246438 - DNA, 23 bp, Artificial sequence
  SiRNA target sequence
tgtggaaaaattaggaacaattt

SEQ ID NO: 246439 - DNA, 23 bp, Artificial sequence
  SiRNA target sequence
gtggaaaaattaggaacaatttc

SEQ ID NO: 246440 - DNA, 23 bp, Artificial sequence
  SiRNA target sequence
tggaaaaattaggaacaatttct

SEQ ID NO: 246441 - DNA, 23 bp, Artificial sequence
  SiRNA target sequence
ggaaaaattaggaacaatttctt

SEQ ID NO: 246442 - DNA, 23 bp, Artificial sequence
  SiRNA target sequence
gaaaaattaggaacaatttcttt

SEQ ID NO: 246443 - DNA, 23 bp, Artificial sequence
  SiRNA target sequence
aaaaattaggaacaatttctttc

SEQ ID NO: 246444 - DNA, 23 bp, Artificial sequence
  SiRNA target sequence
aaaattaggaacaatttctttca

SEQ ID NO: 246445 - DNA, 23 bp, Artificial sequence
  SiRNA target sequence
aaattaggaacaatttctttcat

SEQ ID NO: 246446 - DNA, 23 bp, Artificial sequence
  SiRNA target sequence
aattaggaacaatttctttcatt

SEQ ID NO: 246447 - DNA, 23 bp, Artificial sequence
  SiRNA target sequence
attaggaacaatttctttcattt

SEQ ID NO: 246448 - DNA, 23 bp, Artificial sequence
  SiRNA target sequence
ttaggaacaatttctttcatttc

SEQ ID NO: 246449 - DNA, 23 bp, Artificial sequence
  SiRNA target sequence
taggaacaatttctttcatttca

SEQ ID NO: 246450 - DNA, 23 bp, Artificial sequence
  SiRNA target sequence
aggaacaatttctttcatttcat

SEQ ID NO: 246451 - DNA, 23 bp, Artificial sequence
  SiRNA target sequence
ggaacaatttctttcatttcatc

SEQ ID NO: 246452 - DNA, 23 bp, Artificial sequence
  SiRNA target sequence
gaacaatttctttcatttcatct

SEQ ID NO: 246453 - DNA, 23 bp, Artificial sequence
  SiRNA target sequence
aacaatttctttcatttcatctt

SEQ ID NO: 246454 - DNA, 23 bp, Artificial sequence
  SiRNA target sequence
acaatttctttcatttcatcttc

SEQ ID NO: 246455 - DNA, 23 bp, Artificial sequence
  SiRNA target sequence
caatttctttcatttcatcttct

SEQ ID NO: 246456 - DNA, 23 bp, Artificial sequence
  SiRNA target sequence
aatttctttcatttcatcttctg

SEQ ID NO: 246457 - DNA, 23 bp, Artificial sequence
  SiRNA target sequence
atttctttcatttcatcttctgt

SEQ ID NO: 246458 - DNA, 23 bp, Artificial sequence
  SiRNA target sequence
tttctttcatttcatcttctgta

SEQ ID NO: 246459 - DNA, 23 bp, Artificial sequence
  SiRNA target sequence
ttctttcatttcatcttctgtac

SEQ ID NO: 246460 - DNA, 23 bp, Artificial sequence
  SiRNA target sequence
tctttcatttcatcttctgtaca

SEQ ID NO: 246461 - DNA, 23 bp, Artificial sequence
  SiRNA target sequence
ctttcatttcatcttctgtacaa

SEQ ID NO: 246462 - DNA, 23 bp, Artificial sequence
  SiRNA target sequence
tttcatttcatcttctgtacaag

SEQ ID NO: 246463 - DNA, 23 bp, Artificial sequence
  SiRNA target sequence
ttcatttcatcttctgtacaagc

SEQ ID NO: 246464 - DNA, 23 bp, Artificial sequence
  SiRNA target sequence
tcatttcatcttctgtacaagca

SEQ ID NO: 246465 - DNA, 23 bp, Artificial sequence
  SiRNA target sequence
catttcatcttctgtacaagcat

SEQ ID NO: 246466 - DNA, 23 bp, Artificial sequence
  SiRNA target sequence
atttcatcttctgtacaagcatg

SEQ ID NO: 246467 - DNA, 23 bp, Artificial sequence
  SiRNA target sequence
tttcatcttctgtacaagcatga

SEQ ID NO: 246468 - DNA, 23 bp, Artificial sequence
  SiRNA target sequence
ttcatcttctgtacaagcatgat

SEQ ID NO: 246469 - DNA, 23 bp, Artificial sequence
  SiRNA target sequence
tcatcttctgtacaagcatgatt

SEQ ID NO: 246470 - DNA, 23 bp, Artificial sequence
  SiRNA target sequence
catcttctgtacaagcatgattg

SEQ ID NO: 246471 - DNA, 23 bp, Artificial sequence
  SiRNA target sequence
atcttctgtacaagcatgattgg

SEQ ID NO: 246472 - DNA, 23 bp, Artificial sequence
  SiRNA target sequence
tcttctgtacaagcatgattggc

SEQ ID NO: 246473 - DNA, 23 bp, Artificial sequence
  SiRNA target sequence
cttctgtacaagcatgattggct

SEQ ID NO: 246474 - DNA, 23 bp, Artificial sequence
  SiRNA target sequence
ttctgtacaagcatgattggcta

SEQ ID NO: 246475 - DNA, 23 bp, Artificial sequence
  SiRNA target sequence
tctgtacaagcatgattggctaa

SEQ ID NO: 246476 - DNA, 23 bp, Artificial sequence
  SiRNA target sequence
ctgtacaagcatgattggctaac

SEQ ID NO: 246477 - DNA, 23 bp, Artificial sequence
  SiRNA target sequence
tgtacaagcatgattggctaacg

SEQ ID NO: 246478 - DNA, 23 bp, Artificial sequence
  SiRNA target sequence
gtacaagcatgattggctaacgc

SEQ ID NO: 246479 - DNA, 23 bp, Artificial sequence
  SiRNA target sequence
tacaagcatgattggctaacgca

SEQ ID NO: 246480 - DNA, 23 bp, Artificial sequence
  SiRNA target sequence
acaagcatgattggctaacgcat

SEQ ID NO: 246481 - DNA, 23 bp, Artificial sequence
  SiRNA target sequence
caagcatgattggctaacgcata

SEQ ID NO: 246482 - DNA, 23 bp, Artificial sequence
  SiRNA target sequence
aagcatgattggctaacgcatat

SEQ ID NO: 246483 - DNA, 23 bp, Artificial sequence
  SiRNA target sequence
agcatgattggctaacgcatata

SEQ ID NO: 246484 - DNA, 23 bp, Artificial sequence
  SiRNA target sequence
gcatgattggctaacgcatataa

SEQ ID NO: 246485 - DNA, 23 bp, Artificial sequence
  SiRNA target sequence
catgattggctaacgcatataaa

SEQ ID NO: 246486 - DNA, 23 bp, Artificial sequence
  SiRNA target sequence
atgattggctaacgcatataaag

SEQ ID NO: 246487 - DNA, 23 bp, Artificial sequence
  SiRNA target sequence
tgattggctaacgcatataaagc

SEQ ID NO: 246488 - DNA, 23 bp, Artificial sequence
  SiRNA target sequence
gattggctaacgcatataaagca

SEQ ID NO: 246489 - DNA, 23 bp, Artificial sequence
  SiRNA target sequence
attggctaacgcatataaagcaa

SEQ ID NO: 246490 - DNA, 23 bp, Artificial sequence
  SiRNA target sequence
ttggctaacgcatataaagcaaa

SEQ ID NO: 246491 - DNA, 23 bp, Artificial sequence
  SiRNA target sequence
tggctaacgcatataaagcaaaa

SEQ ID NO: 246492 - DNA, 23 bp, Artificial sequence
  SiRNA target sequence
ggctaacgcatataaagcaaaac

SEQ ID NO: 246493 - DNA, 23 bp, Artificial sequence
  SiRNA target sequence
gctaacgcatataaagcaaaacc

SEQ ID NO: 246494 - DNA, 23 bp, Artificial sequence
  SiRNA target sequence
ctaacgcatataaagcaaaacca

SEQ ID NO: 246495 - DNA, 23 bp, Artificial sequence
  SiRNA target sequence
taacgcatataaagcaaaaccaa

SEQ ID NO: 246496 - DNA, 23 bp, Artificial sequence
  SiRNA target sequence
aacgcatataaagcaaaaccaac

SEQ ID NO: 246497 - DNA, 23 bp, Artificial sequence
  SiRNA target sequence
acgcatataaagcaaaaccaact

SEQ ID NO: 246498 - DNA, 23 bp, Artificial sequence
  SiRNA target sequence
cgcatataaagcaaaaccaacta

SEQ ID NO: 246499 - DNA, 23 bp, Artificial sequence
  SiRNA target sequence
gcatataaagcaaaaccaactac

SEQ ID NO: 246500 - DNA, 23 bp, Artificial sequence
  SiRNA target sequence
catataaagcaaaaccaactact

SEQ ID NO: 246501 - DNA, 23 bp, Artificial sequence
  SiRNA target sequence
atataaagcaaaaccaactacta

SEQ ID NO: 246502 - DNA, 23 bp, Artificial sequence
  SiRNA target sequence
tataaagcaaaaccaactactag

SEQ ID NO: 246503 - DNA, 23 bp, Artificial sequence
  SiRNA target sequence
ataaagcaaaaccaactactaga

SEQ ID NO: 246504 - DNA, 23 bp, Artificial sequence
  SiRNA target sequence
taaagcaaaaccaactactagag

SEQ ID NO: 246505 - DNA, 23 bp, Artificial sequence
  SiRNA target sequence
aaagcaaaaccaactactagagt

SEQ ID NO: 246506 - DNA, 23 bp, Artificial sequence
  SiRNA target sequence
aagcaaaaccaactactagagta

SEQ ID NO: 246507 - DNA, 23 bp, Artificial sequence
  SiRNA target sequence
agcaaaaccaactactagagtac

SEQ ID NO: 246508 - DNA, 23 bp, Artificial sequence
  SiRNA target sequence
gcaaaaccaactactagagtact

SEQ ID NO: 246509 - DNA, 23 bp, Artificial sequence
  SiRNA target sequence
caaaaccaactactagagtactc

SEQ ID NO: 246510 - DNA, 23 bp, Artificial sequence
  SiRNA target sequence
aaaaccaactactagagtactcc

SEQ ID NO: 246511 - DNA, 23 bp, Artificial sequence
  SiRNA target sequence
aaaccaactactagagtactcca

SEQ ID NO: 246512 - DNA, 23 bp, Artificial sequence
  SiRNA target sequence
aaccaactactagagtactccac

SEQ ID NO: 246513 - DNA, 23 bp, Artificial sequence
  SiRNA target sequence
accaactactagagtactccaca

SEQ ID NO: 246514 - DNA, 23 bp, Artificial sequence
  SiRNA target sequence
ccaactactagagtactccacaa

SEQ ID NO: 246515 - DNA, 23 bp, Artificial sequence
  SiRNA target sequence
caactactagagtactccacaac

SEQ ID NO: 246516 - DNA, 23 bp, Artificial sequence
  SiRNA target sequence
aactactagagtactccacaact

SEQ ID NO: 246517 - DNA, 23 bp, Artificial sequence
  SiRNA target sequence
actactagagtactccacaactc

SEQ ID NO: 246518 - DNA, 23 bp, Artificial sequence
  SiRNA target sequence
ctactagagtactccacaactcc

SEQ ID NO: 246519 - DNA, 23 bp, Artificial sequence
  SiRNA target sequence
tactagagtactccacaactccg

SEQ ID NO: 246520 - DNA, 23 bp, Artificial sequence
  SiRNA target sequence
actagagtactccacaactccga

SEQ ID NO: 246521 - DNA, 23 bp, Artificial sequence
  SiRNA target sequence
ctagagtactccacaactccgat

SEQ ID NO: 246522 - DNA, 23 bp, Artificial sequence
  SiRNA target sequence
tagagtactccacaactccgata

SEQ ID NO: 246523 - DNA, 23 bp, Artificial sequence
  SiRNA target sequence
agagtactccacaactccgataa

SEQ ID NO: 246524 - DNA, 23 bp, Artificial sequence
  SiRNA target sequence
gagtactccacaactccgataag

SEQ ID NO: 246525 - DNA, 23 bp, Artificial sequence
  SiRNA target sequence
agtactccacaactccgataaga

SEQ ID NO: 246526 - DNA, 23 bp, Artificial sequence
  SiRNA target sequence
gtactccacaactccgataagat

SEQ ID NO: 246527 - DNA, 23 bp, Artificial sequence
  SiRNA target sequence
tactccacaactccgataagatg

SEQ ID NO: 246528 - DNA, 23 bp, Artificial sequence
  SiRNA target sequence
actccacaactccgataagatgt

SEQ ID NO: 246529 - DNA, 23 bp, Artificial sequence
  SiRNA target sequence
ctccacaactccgataagatgta

SEQ ID NO: 246530 - DNA, 23 bp, Artificial sequence
  SiRNA target sequence
tccacaactccgataagatgtaa

SEQ ID NO: 246531 - DNA, 23 bp, Artificial sequence
  SiRNA target sequence
ccacaactccgataagatgtaac

SEQ ID NO: 246532 - DNA, 23 bp, Artificial sequence
  SiRNA target sequence
cacaactccgataagatgtaaca

SEQ ID NO: 246533 - DNA, 23 bp, Artificial sequence
  SiRNA target sequence
acaactccgataagatgtaacat

SEQ ID NO: 246534 - DNA, 23 bp, Artificial sequence
  SiRNA target sequence
caactccgataagatgtaacata

SEQ ID NO: 246535 - DNA, 23 bp, Artificial sequence
  SiRNA target sequence
aactccgataagatgtaacataa

SEQ ID NO: 246536 - DNA, 23 bp, Artificial sequence
  SiRNA target sequence
actccgataagatgtaacataaa

SEQ ID NO: 246537 - DNA, 23 bp, Artificial sequence
  SiRNA target sequence
ctccgataagatgtaacataaag

SEQ ID NO: 246538 - DNA, 23 bp, Artificial sequence
  SiRNA target sequence
tccgataagatgtaacataaagt

SEQ ID NO: 246539 - DNA, 23 bp, Artificial sequence
  SiRNA target sequence
ccgataagatgtaacataaagta

SEQ ID NO: 246540 - DNA, 23 bp, Artificial sequence
  SiRNA target sequence
cgataagatgtaacataaagtac

SEQ ID NO: 246541 - DNA, 23 bp, Artificial sequence
  SiRNA target sequence
gataagatgtaacataaagtact

SEQ ID NO: 246542 - DNA, 23 bp, Artificial sequence
  SiRNA target sequence
ataagatgtaacataaagtactt

SEQ ID NO: 246543 - DNA, 23 bp, Artificial sequence
  SiRNA target sequence
taagatgtaacataaagtactta

SEQ ID NO: 246544 - DNA, 23 bp, Artificial sequence
  SiRNA target sequence
aagatgtaacataaagtacttat

SEQ ID NO: 246545 - DNA, 23 bp, Artificial sequence
  SiRNA target sequence
agatgtaacataaagtacttatc

SEQ ID NO: 246546 - DNA, 23 bp, Artificial sequence
  SiRNA target sequence
gatgtaacataaagtacttatcc

SEQ ID NO: 246547 - DNA, 23 bp, Artificial sequence
  SiRNA target sequence
atgtaacataaagtacttatcca

SEQ ID NO: 246548 - DNA, 23 bp, Artificial sequence
  SiRNA target sequence
tgtaacataaagtacttatccac

SEQ ID NO: 246549 - DNA, 23 bp, Artificial sequence
  SiRNA target sequence
gtaacataaagtacttatccact

SEQ ID NO: 246550 - DNA, 23 bp, Artificial sequence
  SiRNA target sequence
taacataaagtacttatccactc

SEQ ID NO: 246551 - DNA, 23 bp, Artificial sequence
  SiRNA target sequence
aacataaagtacttatccactca

SEQ ID NO: 246552 - DNA, 23 bp, Artificial sequence
  SiRNA target sequence
acataaagtacttatccactcac

SEQ ID NO: 246553 - DNA, 23 bp, Artificial sequence
  SiRNA target sequence
cataaagtacttatccactcact

SEQ ID NO: 246554 - DNA, 23 bp, Artificial sequence
  SiRNA target sequence
ataaagtacttatccactcactg

SEQ ID NO: 246555 - DNA, 23 bp, Artificial sequence
  SiRNA target sequence
taaagtacttatccactcactgt

SEQ ID NO: 246556 - DNA, 23 bp, Artificial sequence
  SiRNA target sequence
aaagtacttatccactcactgta

SEQ ID NO: 246557 - DNA, 23 bp, Artificial sequence
  SiRNA target sequence
aagtacttatccactcactgtac

SEQ ID NO: 246558 - DNA, 23 bp, Artificial sequence
  SiRNA target sequence
agtacttatccactcactgtaca

SEQ ID NO: 246559 - DNA, 23 bp, Artificial sequence
  SiRNA target sequence
gtacttatccactcactgtacat

SEQ ID NO: 246560 - DNA, 23 bp, Artificial sequence
  SiRNA target sequence
tacttatccactcactgtacata

SEQ ID NO: 246561 - DNA, 23 bp, Artificial sequence
  SiRNA target sequence
acttatccactcactgtacatat

SEQ ID NO: 246562 - DNA, 23 bp, Artificial sequence
  SiRNA target sequence
cttatccactcactgtacatata

SEQ ID NO: 246563 - DNA, 23 bp, Artificial sequence
  SiRNA target sequence
ttatccactcactgtacatatat

SEQ ID NO: 246564 - DNA, 23 bp, Artificial sequence
  SiRNA target sequence
tatccactcactgtacatatata

SEQ ID NO: 246565 - DNA, 23 bp, Artificial sequence
  SiRNA target sequence
atccactcactgtacatatataa

SEQ ID NO: 246566 - DNA, 23 bp, Artificial sequence
  SiRNA target sequence
tccactcactgtacatatataaa

SEQ ID NO: 246567 - DNA, 23 bp, Artificial sequence
  SiRNA target sequence
ccactcactgtacatatataaaa

SEQ ID NO: 246568 - DNA, 23 bp, Artificial sequence
  SiRNA target sequence
cactcactgtacatatataaaaa

SEQ ID NO: 246569 - DNA, 23 bp, Artificial sequence
  SiRNA target sequence
actcactgtacatatataaaaaa

SEQ ID NO: 246570 - DNA, 23 bp, Artificial sequence
  SiRNA target sequence
ctcactgtacatatataaaaaag

SEQ ID NO: 246571 - DNA, 23 bp, Artificial sequence
  SiRNA target sequence
tcactgtacatatataaaaaagg

SEQ ID NO: 246572 - DNA, 23 bp, Artificial sequence
  SiRNA target sequence
cactgtacatatataaaaaagga

SEQ ID NO: 246573 - DNA, 23 bp, Artificial sequence
  SiRNA target sequence
actgtacatatataaaaaaggag

SEQ ID NO: 246574 - DNA, 23 bp, Artificial sequence
  SiRNA target sequence
ctgtacatatataaaaaaggaga

SEQ ID NO: 246575 - DNA, 23 bp, Artificial sequence
  SiRNA target sequence
tgtacatatataaaaaaggagat

SEQ ID NO: 246576 - DNA, 23 bp, Artificial sequence
  SiRNA target sequence
gtacatatataaaaaaggagata

SEQ ID NO: 246577 - DNA, 23 bp, Artificial sequence
  SiRNA target sequence
tacatatataaaaaaggagataa

SEQ ID NO: 246578 - DNA, 23 bp, Artificial sequence
  SiRNA target sequence
acatatataaaaaaggagataag

SEQ ID NO: 246579 - DNA, 23 bp, Artificial sequence
  SiRNA target sequence
catatataaaaaaggagataagc

SEQ ID NO: 246580 - DNA, 23 bp, Artificial sequence
  SiRNA target sequence
atatataaaaaaggagataagcc

SEQ ID NO: 246581 - DNA, 23 bp, Artificial sequence
  SiRNA target sequence
tatataaaaaaggagataagccc

SEQ ID NO: 246582 - DNA, 23 bp, Artificial sequence
  SiRNA target sequence
atataaaaaaggagataagccca

SEQ ID NO: 246583 - DNA, 23 bp, Artificial sequence
  SiRNA target sequence
tataaaaaaggagataagcccat

SEQ ID NO: 246584 - DNA, 23 bp, Artificial sequence
  SiRNA target sequence
ataaaaaaggagataagcccatc

SEQ ID NO: 246585 - DNA, 23 bp, Artificial sequence
  SiRNA target sequence
taaaaaaggagataagcccatca

SEQ ID NO: 246586 - DNA, 23 bp, Artificial sequence
  SiRNA target sequence
aaaaaaggagataagcccatcaa

SEQ ID NO: 246587 - DNA, 23 bp, Artificial sequence
  SiRNA target sequence
aaaaaggagataagcccatcaag

SEQ ID NO: 246588 - DNA, 23 bp, Artificial sequence
  SiRNA target sequence
aaaaggagataagcccatcaagc

SEQ ID NO: 246589 - DNA, 23 bp, Artificial sequence
  SiRNA target sequence
aaaggagataagcccatcaagct

SEQ ID NO: 246590 - DNA, 23 bp, Artificial sequence
  SiRNA target sequence
aaggagataagcccatcaagctt

SEQ ID NO: 246591 - DNA, 23 bp, Artificial sequence
  SiRNA target sequence
aggagataagcccatcaagcttc

SEQ ID NO: 246592 - DNA, 23 bp, Artificial sequence
  SiRNA target sequence
ggagataagcccatcaagcttct

SEQ ID NO: 246593 - DNA, 23 bp, Artificial sequence
  SiRNA target sequence
gagataagcccatcaagcttcta

SEQ ID NO: 246594 - DNA, 23 bp, Artificial sequence
  SiRNA target sequence
agataagcccatcaagcttctaa

SEQ ID NO: 246595 - DNA, 23 bp, Artificial sequence
  SiRNA target sequence
gataagcccatcaagcttctaac

SEQ ID NO: 246596 - DNA, 23 bp, Artificial sequence
  SiRNA target sequence
ataagcccatcaagcttctaact

SEQ ID NO: 246597 - DNA, 23 bp, Artificial sequence
  SiRNA target sequence
taagcccatcaagcttctaactg

SEQ ID NO: 246598 - DNA, 23 bp, Artificial sequence
  SiRNA target sequence
aagcccatcaagcttctaactga

SEQ ID NO: 246599 - DNA, 23 bp, Artificial sequence
  SiRNA target sequence
agcccatcaagcttctaactgac

SEQ ID NO: 246600 - DNA, 23 bp, Artificial sequence
  SiRNA target sequence
gcccatcaagcttctaactgaca

SEQ ID NO: 246601 - DNA, 23 bp, Artificial sequence
  SiRNA target sequence
cccatcaagcttctaactgacat

SEQ ID NO: 246602 - DNA, 23 bp, Artificial sequence
  SiRNA target sequence
ccatcaagcttctaactgacatc

SEQ ID NO: 246603 - DNA, 23 bp, Artificial sequence
  SiRNA target sequence
catcaagcttctaactgacatct

SEQ ID NO: 246604 - DNA, 23 bp, Artificial sequence
  SiRNA target sequence
atcaagcttctaactgacatctt

SEQ ID NO: 246605 - DNA, 23 bp, Artificial sequence
  SiRNA target sequence
tcaagcttctaactgacatctta

SEQ ID NO: 246606 - DNA, 23 bp, Artificial sequence
  SiRNA target sequence
caagcttctaactgacatcttac

SEQ ID NO: 246607 - DNA, 23 bp, Artificial sequence
  SiRNA target sequence
aagcttctaactgacatcttacc

SEQ ID NO: 246608 - DNA, 23 bp, Artificial sequence
  SiRNA target sequence
agcttctaactgacatcttacca

SEQ ID NO: 246609 - DNA, 23 bp, Artificial sequence
  SiRNA target sequence
gcttctaactgacatcttaccat

SEQ ID NO: 246610 - DNA, 23 bp, Artificial sequence
  SiRNA target sequence
cttctaactgacatcttaccatc

SEQ ID NO: 246611 - DNA, 23 bp, Artificial sequence
  SiRNA target sequence
ttctaactgacatcttaccatca

SEQ ID NO: 246612 - DNA, 23 bp, Artificial sequence
  SiRNA target sequence
tctaactgacatcttaccatcac

SEQ ID NO: 246613 - DNA, 23 bp, Artificial sequence
  SiRNA target sequence
ctaactgacatcttaccatcaca

SEQ ID NO: 246614 - DNA, 23 bp, Artificial sequence
  SiRNA target sequence
taactgacatcttaccatcacaa

SEQ ID NO: 246615 - DNA, 23 bp, Artificial sequence
  SiRNA target sequence
aactgacatcttaccatcacaaa

SEQ ID NO: 246616 - DNA, 23 bp, Artificial sequence
  SiRNA target sequence
actgacatcttaccatcacaaaa

SEQ ID NO: 246617 - DNA, 23 bp, Artificial sequence
  SiRNA target sequence
ctgacatcttaccatcacaaaaa

SEQ ID NO: 246618 - DNA, 23 bp, Artificial sequence
  SiRNA target sequence
tgacatcttaccatcacaaaaaa

SEQ ID NO: 246619 - DNA, 23 bp, Artificial sequence
  SiRNA target sequence
gacatcttaccatcacaaaaaat

SEQ ID NO: 246620 - DNA, 23 bp, Artificial sequence
  SiRNA target sequence
acatcttaccatcacaaaaaata

SEQ ID NO: 246621 - DNA, 23 bp, Artificial sequence
  SiRNA target sequence
catcttaccatcacaaaaaatat

SEQ ID NO: 246622 - DNA, 23 bp, Artificial sequence
  SiRNA target sequence
atcttaccatcacaaaaaatatc

SEQ ID NO: 246623 - DNA, 23 bp, Artificial sequence
  SiRNA target sequence
tcttaccatcacaaaaaatatct

SEQ ID NO: 246624 - DNA, 23 bp, Artificial sequence
  SiRNA target sequence
cttaccatcacaaaaaatatcta

SEQ ID NO: 246625 - DNA, 23 bp, Artificial sequence
  SiRNA target sequence
ttaccatcacaaaaaatatctag

SEQ ID NO: 246626 - DNA, 23 bp, Artificial sequence
  SiRNA target sequence
taccatcacaaaaaatatctagt

SEQ ID NO: 246627 - DNA, 23 bp, Artificial sequence
  SiRNA target sequence
accatcacaaaaaatatctagtg

SEQ ID NO: 246628 - DNA, 23 bp, Artificial sequence
  SiRNA target sequence
ccatcacaaaaaatatctagtgc

SEQ ID NO: 246629 - DNA, 23 bp, Artificial sequence
  SiRNA target sequence
catcacaaaaaatatctagtgcc

SEQ ID NO: 246630 - DNA, 23 bp, Artificial sequence
  SiRNA target sequence
atcacaaaaaatatctagtgccc

SEQ ID NO: 246631 - DNA, 23 bp, Artificial sequence
  SiRNA target sequence
tcacaaaaaatatctagtgccca

SEQ ID NO: 246632 - DNA, 23 bp, Artificial sequence
  SiRNA target sequence
cacaaaaaatatctagtgcccat

SEQ ID NO: 246633 - DNA, 23 bp, Artificial sequence
  SiRNA target sequence
acaaaaaatatctagtgcccatt

SEQ ID NO: 246634 - DNA, 23 bp, Artificial sequence
  SiRNA target sequence
caaaaaatatctagtgcccattg

SEQ ID NO: 246635 - DNA, 23 bp, Artificial sequence
  SiRNA target sequence
aaaaaatatctagtgcccattgt

SEQ ID NO: 246636 - DNA, 23 bp, Artificial sequence
  SiRNA target sequence
aaaaatatctagtgcccattgtg

SEQ ID NO: 246637 - DNA, 23 bp, Artificial sequence
  SiRNA target sequence
aaaatatctagtgcccattgtga

SEQ ID NO: 246638 - DNA, 23 bp, Artificial sequence
  SiRNA target sequence
aaatatctagtgcccattgtgat

SEQ ID NO: 246639 - DNA, 23 bp, Artificial sequence
  SiRNA target sequence
aatatctagtgcccattgtgatc

SEQ ID NO: 246640 - DNA, 23 bp, Artificial sequence
  SiRNA target sequence
atatctagtgcccattgtgatcc

SEQ ID NO: 246641 - DNA, 23 bp, Artificial sequence
  SiRNA target sequence
tatctagtgcccattgtgatcct

SEQ ID NO: 246642 - DNA, 23 bp, Artificial sequence
  SiRNA target sequence
atctagtgcccattgtgatcctt

SEQ ID NO: 246643 - DNA, 23 bp, Artificial sequence
  SiRNA target sequence
tctagtgcccattgtgatccttt

SEQ ID NO: 246644 - DNA, 23 bp, Artificial sequence
  SiRNA target sequence
ctagtgcccattgtgatcctttt

SEQ ID NO: 246645 - DNA, 23 bp, Artificial sequence
  SiRNA target sequence
tagtgcccattgtgatccttttt

SEQ ID NO: 246646 - DNA, 23 bp, Artificial sequence
  SiRNA target sequence
agtgcccattgtgatcctttttg

SEQ ID NO: 246647 - DNA, 23 bp, Artificial sequence
  SiRNA target sequence
gtgcccattgtgatcctttttgg

SEQ ID NO: 246648 - DNA, 23 bp, Artificial sequence
  SiRNA target sequence
tgcccattgtgatcctttttgga

SEQ ID NO: 246649 - DNA, 23 bp, Artificial sequence
  SiRNA target sequence
gcccattgtgatcctttttggat

SEQ ID NO: 246650 - DNA, 23 bp, Artificial sequence
  SiRNA target sequence
cccattgtgatcctttttggatt

SEQ ID NO: 246651 - DNA, 23 bp, Artificial sequence
  SiRNA target sequence
ccattgtgatcctttttggattt

SEQ ID NO: 246652 - DNA, 23 bp, Artificial sequence
  SiRNA target sequence
cattgtgatcctttttggatttt

SEQ ID NO: 246653 - DNA, 23 bp, Artificial sequence
  SiRNA target sequence
attgtgatcctttttggatttta

SEQ ID NO: 246654 - DNA, 23 bp, Artificial sequence
  SiRNA target sequence
ttgtgatcctttttggattttat

SEQ ID NO: 246655 - DNA, 23 bp, Artificial sequence
  SiRNA target sequence
tgtgatcctttttggattttata

SEQ ID NO: 246656 - DNA, 23 bp, Artificial sequence
  SiRNA target sequence
gtgatcctttttggattttatat

SEQ ID NO: 246657 - DNA, 23 bp, Artificial sequence
  SiRNA target sequence
tgatcctttttggattttatatt

SEQ ID NO: 246658 - DNA, 23 bp, Artificial sequence
  SiRNA target sequence
gatcctttttggattttatattc

SEQ ID NO: 246659 - DNA, 23 bp, Artificial sequence
  SiRNA target sequence
atcctttttggattttatattca

SEQ ID NO: 246660 - DNA, 23 bp, Artificial sequence
  SiRNA target sequence
tcctttttggattttatattcaa

SEQ ID NO: 246661 - DNA, 23 bp, Artificial sequence
  SiRNA target sequence
cctttttggattttatattcaaa

SEQ ID NO: 246662 - DNA, 23 bp, Artificial sequence
  SiRNA target sequence
ctttttggattttatattcaaat

SEQ ID NO: 246663 - DNA, 23 bp, Artificial sequence
  SiRNA target sequence
tttttggattttatattcaaatg

SEQ ID NO: 246664 - DNA, 23 bp, Artificial sequence
  SiRNA target sequence
ttttggattttatattcaaatgg

SEQ ID NO: 246665 - DNA, 23 bp, Artificial sequence
  SiRNA target sequence
tttggattttatattcaaatgga

SEQ ID NO: 246666 - DNA, 23 bp, Artificial sequence
  SiRNA target sequence
ttggattttatattcaaatggaa

SEQ ID NO: 246667 - DNA, 23 bp, Artificial sequence
  SiRNA target sequence
tggattttatattcaaatggaat

SEQ ID NO: 246668 - DNA, 23 bp, Artificial sequence
  SiRNA target sequence
ggattttatattcaaatggaatt

SEQ ID NO: 246669 - DNA, 23 bp, Artificial sequence
  SiRNA target sequence
gattttatattcaaatggaatta

SEQ ID NO: 246670 - DNA, 23 bp, Artificial sequence
  SiRNA target sequence
attttatattcaaatggaattaa

SEQ ID NO: 246671 - DNA, 23 bp, Artificial sequence
  SiRNA target sequence
ttttatattcaaatggaattaaa

SEQ ID NO: 246672 - DNA, 23 bp, Artificial sequence
  SiRNA target sequence
tttatattcaaatggaattaaaa

SEQ ID NO: 246673 - DNA, 23 bp, Artificial sequence
  SiRNA target sequence
ttatattcaaatggaattaaaag

SEQ ID NO: 246674 - DNA, 23 bp, Artificial sequence
  SiRNA target sequence
tatattcaaatggaattaaaaga

SEQ ID NO: 246675 - DNA, 23 bp, Artificial sequence
  SiRNA target sequence
atattcaaatggaattaaaagag

SEQ ID NO: 246676 - DNA, 23 bp, Artificial sequence
  SiRNA target sequence
tattcaaatggaattaaaagaga

SEQ ID NO: 246677 - DNA, 23 bp, Artificial sequence
  SiRNA target sequence
attcaaatggaattaaaagagaa

SEQ ID NO: 246678 - DNA, 23 bp, Artificial sequence
  SiRNA target sequence
ttcaaatggaattaaaagagaac

SEQ ID NO: 246679 - DNA, 23 bp, Artificial sequence
  SiRNA target sequence
tcaaatggaattaaaagagaacc

SEQ ID NO: 246680 - DNA, 23 bp, Artificial sequence
  SiRNA target sequence
caaatggaattaaaagagaacca

SEQ ID NO: 246681 - DNA, 23 bp, Artificial sequence
  SiRNA target sequence
aaatggaattaaaagagaaccaa

SEQ ID NO: 246682 - DNA, 23 bp, Artificial sequence
  SiRNA target sequence
aatggaattaaaagagaaccaat

SEQ ID NO: 246683 - DNA, 23 bp, Artificial sequence
  SiRNA target sequence
atggaattaaaagagaaccaatt

SEQ ID NO: 246684 - DNA, 23 bp, Artificial sequence
  SiRNA target sequence
tggaattaaaagagaaccaatta

SEQ ID NO: 246685 - DNA, 23 bp, Artificial sequence
  SiRNA target sequence
ggaattaaaagagaaccaattag

SEQ ID NO: 246686 - DNA, 23 bp, Artificial sequence
  SiRNA target sequence
gaattaaaagagaaccaattaga

SEQ ID NO: 246687 - DNA, 23 bp, Artificial sequence
  SiRNA target sequence
aattaaaagagaaccaattagaa

SEQ ID NO: 246688 - DNA, 23 bp, Artificial sequence
  SiRNA target sequence
attaaaagagaaccaattagaaa

SEQ ID NO: 246689 - DNA, 23 bp, Artificial sequence
  SiRNA target sequence
ttaaaagagaaccaattagaaaa

SEQ ID NO: 246690 - DNA, 23 bp, Artificial sequence
  SiRNA target sequence
taaaagagaaccaattagaaaaa

SEQ ID NO: 246691 - DNA, 23 bp, Artificial sequence
  SiRNA target sequence
aaaagagaaccaattagaaaaaa

SEQ ID NO: 246692 - DNA, 23 bp, Artificial sequence
  SiRNA target sequence
aaagagaaccaattagaaaaaaa

SEQ ID NO: 246693 - DNA, 23 bp, Artificial sequence
  SiRNA target sequence
aagagaaccaattagaaaaaaaa

SEQ ID NO: 246694 - DNA, 23 bp, Artificial sequence
  SiRNA target sequence
agagaaccaattagaaaaaaaat

SEQ ID NO: 246695 - DNA, 23 bp, Artificial sequence
  SiRNA target sequence
gagaaccaattagaaaaaaaatg

SEQ ID NO: 246696 - DNA, 23 bp, Artificial sequence
  SiRNA target sequence
agaaccaattagaaaaaaaatgc

SEQ ID NO: 246697 - DNA, 23 bp, Artificial sequence
  SiRNA target sequence
gaaccaattagaaaaaaaatgcc

SEQ ID NO: 246698 - DNA, 23 bp, Artificial sequence
  SiRNA target sequence
aaccaattagaaaaaaaatgcca

SEQ ID NO: 246699 - DNA, 23 bp, Artificial sequence
  SiRNA target sequence
accaattagaaaaaaaatgccaa

SEQ ID NO: 246700 - DNA, 23 bp, Artificial sequence
  SiRNA target sequence
ccaattagaaaaaaaatgccaat

SEQ ID NO: 246701 - DNA, 23 bp, Artificial sequence
  SiRNA target sequence
caattagaaaaaaaatgccaata

SEQ ID NO: 246702 - DNA, 23 bp, Artificial sequence
  SiRNA target sequence
aattagaaaaaaaatgccaataa

SEQ ID NO: 246703 - DNA, 23 bp, Artificial sequence
  SiRNA target sequence
attagaaaaaaaatgccaataaa

SEQ ID NO: 246704 - DNA, 23 bp, Artificial sequence
  SiRNA target sequence
ttagaaaaaaaatgccaataaaa

SEQ ID NO: 246705 - DNA, 23 bp, Artificial sequence
  SiRNA target sequence
tagaaaaaaaatgccaataaaac

SEQ ID NO: 246706 - DNA, 23 bp, Artificial sequence
  SiRNA target sequence
agaaaaaaaatgccaataaaacc

SEQ ID NO: 246707 - DNA, 23 bp, Artificial sequence
  SiRNA target sequence
gaaaaaaaatgccaataaaacca

SEQ ID NO: 246708 - DNA, 23 bp, Artificial sequence
  SiRNA target sequence
aaaaaaaatgccaataaaaccaa

SEQ ID NO: 246709 - DNA, 23 bp, Artificial sequence
  SiRNA target sequence
aaaaaaatgccaataaaaccaaa

SEQ ID NO: 246710 - DNA, 23 bp, Artificial sequence
  SiRNA target sequence
aaaaaatgccaataaaaccaaaa

SEQ ID NO: 246711 - DNA, 23 bp, Artificial sequence
  SiRNA target sequence
aaaaatgccaataaaaccaaaaa

SEQ ID NO: 246712 - DNA, 23 bp, Artificial sequence
  SiRNA target sequence
aaaatgccaataaaaccaaaaat

SEQ ID NO: 246713 - DNA, 23 bp, Artificial sequence
  SiRNA target sequence
aaatgccaataaaaccaaaaata

SEQ ID NO: 246714 - DNA, 23 bp, Artificial sequence
  SiRNA target sequence
aatgccaataaaaccaaaaataa

SEQ ID NO: 246715 - DNA, 23 bp, Artificial sequence
  SiRNA target sequence
atgccaataaaaccaaaaataat

SEQ ID NO: 246716 - DNA, 23 bp, Artificial sequence
  SiRNA target sequence
tgccaataaaaccaaaaataata

SEQ ID NO: 246717 - DNA, 23 bp, Artificial sequence
  SiRNA target sequence
gccaataaaaccaaaaataataa

SEQ ID NO: 246718 - DNA, 23 bp, Artificial sequence
  SiRNA target sequence
ccaataaaaccaaaaataataaa

SEQ ID NO: 246719 - DNA, 23 bp, Artificial sequence
  SiRNA target sequence
caataaaaccaaaaataataaaa

SEQ ID NO: 246720 - DNA, 23 bp, Artificial sequence
  SiRNA target sequence
aataaaaccaaaaataataaaat

SEQ ID NO: 246721 - DNA, 23 bp, Artificial sequence
  SiRNA target sequence
ataaaaccaaaaataataaaatt

SEQ ID NO: 246722 - DNA, 23 bp, Artificial sequence
  SiRNA target sequence
taaaaccaaaaataataaaattc

SEQ ID NO: 246723 - DNA, 23 bp, Artificial sequence
  SiRNA target sequence
aaaaccaaaaataataaaattca

SEQ ID NO: 246724 - DNA, 23 bp, Artificial sequence
  SiRNA target sequence
aaaccaaaaataataaaattcac

SEQ ID NO: 246725 - DNA, 23 bp, Artificial sequence
  SiRNA target sequence
aaccaaaaataataaaattcaca

SEQ ID NO: 246726 - DNA, 23 bp, Artificial sequence
  SiRNA target sequence
accaaaaataataaaattcacaa

SEQ ID NO: 246727 - DNA, 23 bp, Artificial sequence
  SiRNA target sequence
ccaaaaataataaaattcacaat

SEQ ID NO: 246728 - DNA, 23 bp, Artificial sequence
  SiRNA target sequence
caaaaataataaaattcacaata

SEQ ID NO: 246729 - DNA, 23 bp, Artificial sequence
  SiRNA target sequence
aaaaataataaaattcacaatac

SEQ ID NO: 246730 - DNA, 23 bp, Artificial sequence
  SiRNA target sequence
aaaataataaaattcacaatact

SEQ ID NO: 246731 - DNA, 23 bp, Artificial sequence
  SiRNA target sequence
aaataataaaattcacaatacta

SEQ ID NO: 246732 - DNA, 23 bp, Artificial sequence
  SiRNA target sequence
aataataaaattcacaatactaa

SEQ ID NO: 246733 - DNA, 23 bp, Artificial sequence
  SiRNA target sequence
ataataaaattcacaatactaag

SEQ ID NO: 246734 - DNA, 23 bp, Artificial sequence
  SiRNA target sequence
taataaaattcacaatactaaga

SEQ ID NO: 246735 - DNA, 23 bp, Artificial sequence
  SiRNA target sequence
aataaaattcacaatactaagaa

SEQ ID NO: 246736 - DNA, 23 bp, Artificial sequence
  SiRNA target sequence
ataaaattcacaatactaagaat

SEQ ID NO: 246737 - DNA, 23 bp, Artificial sequence
  SiRNA target sequence
taaaattcacaatactaagaata

SEQ ID NO: 246738 - DNA, 23 bp, Artificial sequence
  SiRNA target sequence
aaaattcacaatactaagaatag

SEQ ID NO: 246739 - DNA, 23 bp, Artificial sequence
  SiRNA target sequence
aaattcacaatactaagaataga

SEQ ID NO: 246740 - DNA, 23 bp, Artificial sequence
  SiRNA target sequence
aattcacaatactaagaatagag

SEQ ID NO: 246741 - DNA, 23 bp, Artificial sequence
  SiRNA target sequence
attcacaatactaagaatagagt

SEQ ID NO: 246742 - DNA, 23 bp, Artificial sequence
  SiRNA target sequence
ttcacaatactaagaatagagta

SEQ ID NO: 246743 - DNA, 23 bp, Artificial sequence
  SiRNA target sequence
tcacaatactaagaatagagtac

SEQ ID NO: 246744 - DNA, 23 bp, Artificial sequence
  SiRNA target sequence
cacaatactaagaatagagtaca

SEQ ID NO: 246745 - DNA, 23 bp, Artificial sequence
  SiRNA target sequence
acaatactaagaatagagtacac

SEQ ID NO: 246746 - DNA, 23 bp, Artificial sequence
  SiRNA target sequence
caatactaagaatagagtacaca

SEQ ID NO: 246747 - DNA, 23 bp, Artificial sequence
  SiRNA target sequence
aatactaagaatagagtacacat

SEQ ID NO: 246748 - DNA, 23 bp, Artificial sequence
  SiRNA target sequence
atactaagaatagagtacacatt

SEQ ID NO: 246749 - DNA, 23 bp, Artificial sequence
  SiRNA target sequence
tactaagaatagagtacacattt

SEQ ID NO: 246750 - DNA, 23 bp, Artificial sequence
  SiRNA target sequence
actaagaatagagtacacattta

SEQ ID NO: 246751 - DNA, 23 bp, Artificial sequence
  SiRNA target sequence
ctaagaatagagtacacatttaa

SEQ ID NO: 246752 - DNA, 23 bp, Artificial sequence
  SiRNA target sequence
taagaatagagtacacatttaaa

SEQ ID NO: 246753 - DNA, 23 bp, Artificial sequence
  SiRNA target sequence
aagaatagagtacacatttaaag

SEQ ID NO: 246754 - DNA, 23 bp, Artificial sequence
  SiRNA target sequence
agaatagagtacacatttaaagc

SEQ ID NO: 246755 - DNA, 23 bp, Artificial sequence
  SiRNA target sequence
gaatagagtacacatttaaagcc

SEQ ID NO: 246756 - DNA, 23 bp, Artificial sequence
  SiRNA target sequence
aatagagtacacatttaaagcct

SEQ ID NO: 246757 - DNA, 23 bp, Artificial sequence
  SiRNA target sequence
atagagtacacatttaaagcctt

SEQ ID NO: 246758 - DNA, 23 bp, Artificial sequence
  SiRNA target sequence
tagagtacacatttaaagccttt

SEQ ID NO: 246759 - DNA, 23 bp, Artificial sequence
  SiRNA target sequence
agagtacacatttaaagcctttt

SEQ ID NO: 246760 - DNA, 23 bp, Artificial sequence
  SiRNA target sequence
gagtacacatttaaagccttttg

SEQ ID NO: 246761 - DNA, 23 bp, Artificial sequence
  SiRNA target sequence
agtacacatttaaagccttttgg

SEQ ID NO: 246762 - DNA, 23 bp, Artificial sequence
  SiRNA target sequence
gtacacatttaaagccttttgga

SEQ ID NO: 246763 - DNA, 23 bp, Artificial sequence
  SiRNA target sequence
tacacatttaaagccttttggac

SEQ ID NO: 246764 - DNA, 23 bp, Artificial sequence
  SiRNA target sequence
acacatttaaagccttttggaca

SEQ ID NO: 246765 - DNA, 23 bp, Artificial sequence
  SiRNA target sequence
cacatttaaagccttttggacat

SEQ ID NO: 246766 - DNA, 23 bp, Artificial sequence
  SiRNA target sequence
acatttaaagccttttggacata

SEQ ID NO: 246767 - DNA, 23 bp, Artificial sequence
  SiRNA target sequence
catttaaagccttttggacatat

SEQ ID NO: 246768 - DNA, 23 bp, Artificial sequence
  SiRNA target sequence
atttaaagccttttggacatatg

SEQ ID NO: 246769 - DNA, 23 bp, Artificial sequence
  SiRNA target sequence
tttaaagccttttggacatatga

SEQ ID NO: 246770 - DNA, 23 bp, Artificial sequence
  SiRNA target sequence
ttaaagccttttggacatatgac

SEQ ID NO: 246771 - DNA, 23 bp, Artificial sequence
  SiRNA target sequence
taaagccttttggacatatgaca

SEQ ID NO: 246772 - DNA, 23 bp, Artificial sequence
  SiRNA target sequence
aaagccttttggacatatgacat

SEQ ID NO: 246773 - DNA, 23 bp, Artificial sequence
  SiRNA target sequence
aagccttttggacatatgacatc

SEQ ID NO: 246774 - DNA, 23 bp, Artificial sequence
  SiRNA target sequence
agccttttggacatatgacatca

SEQ ID NO: 246775 - DNA, 23 bp, Artificial sequence
  SiRNA target sequence
gccttttggacatatgacatcat

SEQ ID NO: 246776 - DNA, 23 bp, Artificial sequence
  SiRNA target sequence
ccttttggacatatgacatcata

SEQ ID NO: 246777 - DNA, 23 bp, Artificial sequence
  SiRNA target sequence
cttttggacatatgacatcataa

SEQ ID NO: 246778 - DNA, 23 bp, Artificial sequence
  SiRNA target sequence
ttttggacatatgacatcataag

SEQ ID NO: 246779 - DNA, 23 bp, Artificial sequence
  SiRNA target sequence
tttggacatatgacatcataaga

SEQ ID NO: 246780 - DNA, 23 bp, Artificial sequence
  SiRNA target sequence
ttggacatatgacatcataagac

SEQ ID NO: 246781 - DNA, 23 bp, Artificial sequence
  SiRNA target sequence
tggacatatgacatcataagaca

SEQ ID NO: 246782 - DNA, 23 bp, Artificial sequence
  SiRNA target sequence
ggacatatgacatcataagacat

SEQ ID NO: 246783 - DNA, 23 bp, Artificial sequence
  SiRNA target sequence
gacatatgacatcataagacata

SEQ ID NO: 246784 - DNA, 23 bp, Artificial sequence
  SiRNA target sequence
acatatgacatcataagacatat

SEQ ID NO: 246785 - DNA, 23 bp, Artificial sequence
  SiRNA target sequence
catatgacatcataagacatata

SEQ ID NO: 246786 - DNA, 23 bp, Artificial sequence
  SiRNA target sequence
atatgacatcataagacatataa

SEQ ID NO: 246787 - DNA, 23 bp, Artificial sequence
  SiRNA target sequence
tatgacatcataagacatataat

SEQ ID NO: 246788 - DNA, 23 bp, Artificial sequence
  SiRNA target sequence
atgacatcataagacatataatt

SEQ ID NO: 246789 - DNA, 23 bp, Artificial sequence
  SiRNA target sequence
tgacatcataagacatataattg

SEQ ID NO: 246790 - DNA, 23 bp, Artificial sequence
  SiRNA target sequence
gacatcataagacatataattgg

SEQ ID NO: 246791 - DNA, 23 bp, Artificial sequence
  SiRNA target sequence
acatcataagacatataattggc

SEQ ID NO: 246792 - DNA, 23 bp, Artificial sequence
  SiRNA target sequence
catcataagacatataattggca

SEQ ID NO: 246793 - DNA, 23 bp, Artificial sequence
  SiRNA target sequence
atcataagacatataattggcag

SEQ ID NO: 246794 - DNA, 23 bp, Artificial sequence
  SiRNA target sequence
tcataagacatataattggcagt

SEQ ID NO: 246795 - DNA, 23 bp, Artificial sequence
  SiRNA target sequence
cataagacatataattggcagtg

SEQ ID NO: 246796 - DNA, 23 bp, Artificial sequence
  SiRNA target sequence
ataagacatataattggcagtga

SEQ ID NO: 246797 - DNA, 23 bp, Artificial sequence
  SiRNA target sequence
taagacatataattggcagtgaa

SEQ ID NO: 246798 - DNA, 23 bp, Artificial sequence
  SiRNA target sequence
aagacatataattggcagtgaaa

SEQ ID NO: 246799 - DNA, 23 bp, Artificial sequence
  SiRNA target sequence
agacatataattggcagtgaaaa

SEQ ID NO: 246800 - DNA, 23 bp, Artificial sequence
  SiRNA target sequence
gacatataattggcagtgaaaag

SEQ ID NO: 246801 - DNA, 23 bp, Artificial sequence
  SiRNA target sequence
acatataattggcagtgaaaaga

SEQ ID NO: 246802 - DNA, 23 bp, Artificial sequence
  SiRNA target sequence
catataattggcagtgaaaagaa

SEQ ID NO: 246803 - DNA, 23 bp, Artificial sequence
  SiRNA target sequence
atataattggcagtgaaaagaaa

SEQ ID NO: 246804 - DNA, 23 bp, Artificial sequence
  SiRNA target sequence
tataattggcagtgaaaagaaaa

SEQ ID NO: 246805 - DNA, 23 bp, Artificial sequence
  SiRNA target sequence
ataattggcagtgaaaagaaaag

SEQ ID NO: 246806 - DNA, 23 bp, Artificial sequence
  SiRNA target sequence
taattggcagtgaaaagaaaagc

SEQ ID NO: 246807 - DNA, 23 bp, Artificial sequence
  SiRNA target sequence
aattggcagtgaaaagaaaagct

SEQ ID NO: 246808 - DNA, 23 bp, Artificial sequence
  SiRNA target sequence
attggcagtgaaaagaaaagctt

SEQ ID NO: 246809 - DNA, 23 bp, Artificial sequence
  SiRNA target sequence
ttggcagtgaaaagaaaagcttt

SEQ ID NO: 246810 - DNA, 23 bp, Artificial sequence
  SiRNA target sequence
tggcagtgaaaagaaaagcttta

SEQ ID NO: 246811 - DNA, 23 bp, Artificial sequence
  SiRNA target sequence
ggcagtgaaaagaaaagctttat

SEQ ID NO: 246812 - DNA, 23 bp, Artificial sequence
  SiRNA target sequence
gcagtgaaaagaaaagctttatg

SEQ ID NO: 246813 - DNA, 23 bp, Artificial sequence
  SiRNA target sequence
cagtgaaaagaaaagctttatgt

SEQ ID NO: 246814 - DNA, 23 bp, Artificial sequence
  SiRNA target sequence
agtgaaaagaaaagctttatgta

SEQ ID NO: 246815 - DNA, 23 bp, Artificial sequence
  SiRNA target sequence
gtgaaaagaaaagctttatgtag

SEQ ID NO: 246816 - DNA, 23 bp, Artificial sequence
  SiRNA target sequence
tgaaaagaaaagctttatgtagt

SEQ ID NO: 246817 - DNA, 23 bp, Artificial sequence
  SiRNA target sequence
gaaaagaaaagctttatgtagta

SEQ ID NO: 246818 - DNA, 23 bp, Artificial sequence
  SiRNA target sequence
aaaagaaaagctttatgtagtac

SEQ ID NO: 246819 - DNA, 23 bp, Artificial sequence
  SiRNA target sequence
aaagaaaagctttatgtagtaca

SEQ ID NO: 246820 - DNA, 23 bp, Artificial sequence
  SiRNA target sequence
aagaaaagctttatgtagtacag

SEQ ID NO: 246821 - DNA, 23 bp, Artificial sequence
  SiRNA target sequence
agaaaagctttatgtagtacagt

SEQ ID NO: 246822 - DNA, 23 bp, Artificial sequence
  SiRNA target sequence
gaaaagctttatgtagtacagtg

SEQ ID NO: 246823 - DNA, 23 bp, Artificial sequence
  SiRNA target sequence
aaaagctttatgtagtacagtga

SEQ ID NO: 246824 - DNA, 23 bp, Artificial sequence
  SiRNA target sequence
aaagctttatgtagtacagtgac

SEQ ID NO: 246825 - DNA, 23 bp, Artificial sequence
  SiRNA target sequence
aagctttatgtagtacagtgacg

SEQ ID NO: 246826 - DNA, 23 bp, Artificial sequence
  SiRNA target sequence
agctttatgtagtacagtgacga

SEQ ID NO: 246827 - DNA, 23 bp, Artificial sequence
  SiRNA target sequence
gctttatgtagtacagtgacgaa

SEQ ID NO: 246828 - DNA, 23 bp, Artificial sequence
  SiRNA target sequence
ctttatgtagtacagtgacgaag

SEQ ID NO: 246829 - DNA, 23 bp, Artificial sequence
  SiRNA target sequence
tttatgtagtacagtgacgaagg

SEQ ID NO: 246830 - DNA, 23 bp, Artificial sequence
  SiRNA target sequence
ttatgtagtacagtgacgaagga

SEQ ID NO: 246831 - DNA, 23 bp, Artificial sequence
  SiRNA target sequence
tatgtagtacagtgacgaaggaa

SEQ ID NO: 246832 - DNA, 23 bp, Artificial sequence
  SiRNA target sequence
atgtagtacagtgacgaaggaat

SEQ ID NO: 246833 - DNA, 23 bp, Artificial sequence
  SiRNA target sequence
tgtagtacagtgacgaaggaatt

SEQ ID NO: 246834 - DNA, 23 bp, Artificial sequence
  SiRNA target sequence
gtagtacagtgacgaaggaattt

SEQ ID NO: 246835 - DNA, 23 bp, Artificial sequence
  SiRNA target sequence
tagtacagtgacgaaggaatttg

SEQ ID NO: 246836 - DNA, 23 bp, Artificial sequence
  SiRNA target sequence
agtacagtgacgaaggaatttgt

SEQ ID NO: 246837 - DNA, 23 bp, Artificial sequence
  SiRNA target sequence
gtacagtgacgaaggaatttgtt

SEQ ID NO: 246838 - DNA, 23 bp, Artificial sequence
  SiRNA target sequence
tacagtgacgaaggaatttgttt

SEQ ID NO: 246839 - DNA, 23 bp, Artificial sequence
  SiRNA target sequence
acagtgacgaaggaatttgtttt

SEQ ID NO: 246840 - DNA, 23 bp, Artificial sequence
  SiRNA target sequence
cagtgacgaaggaatttgttttg

SEQ ID NO: 246841 - DNA, 23 bp, Artificial sequence
  SiRNA target sequence
agtgacgaaggaatttgttttgt

SEQ ID NO: 246842 - DNA, 23 bp, Artificial sequence
  SiRNA target sequence
gtgacgaaggaatttgttttgtc

SEQ ID NO: 246843 - DNA, 23 bp, Artificial sequence
  SiRNA target sequence
tgacgaaggaatttgttttgtca

SEQ ID NO: 246844 - DNA, 23 bp, Artificial sequence
  SiRNA target sequence
gacgaaggaatttgttttgtcat

SEQ ID NO: 246845 - DNA, 23 bp, Artificial sequence
  SiRNA target sequence
acgaaggaatttgttttgtcata

SEQ ID NO: 246846 - DNA, 23 bp, Artificial sequence
  SiRNA target sequence
cgaaggaatttgttttgtcataa

SEQ ID NO: 246847 - DNA, 23 bp, Artificial sequence
  SiRNA target sequence
gaaggaatttgttttgtcataat

SEQ ID NO: 246848 - DNA, 23 bp, Artificial sequence
  SiRNA target sequence
aaggaatttgttttgtcataatc

SEQ ID NO: 246849 - DNA, 23 bp, Artificial sequence
  SiRNA target sequence
aggaatttgttttgtcataatca

SEQ ID NO: 246850 - DNA, 23 bp, Artificial sequence
  SiRNA target sequence
ggaatttgttttgtcataatcac

SEQ ID NO: 246851 - DNA, 23 bp, Artificial sequence
  SiRNA target sequence
gaatttgttttgtcataatcacg

SEQ ID NO: 246852 - DNA, 23 bp, Artificial sequence
  SiRNA target sequence
aatttgttttgtcataatcacga

SEQ ID NO: 246853 - DNA, 23 bp, Artificial sequence
  SiRNA target sequence
atttgttttgtcataatcacgat

SEQ ID NO: 246854 - DNA, 23 bp, Artificial sequence
  SiRNA target sequence
tttgttttgtcataatcacgatt

SEQ ID NO: 246855 - DNA, 23 bp, Artificial sequence
  SiRNA target sequence
ttgttttgtcataatcacgattt

SEQ ID NO: 246856 - DNA, 23 bp, Artificial sequence
  SiRNA target sequence
tgttttgtcataatcacgatttc

SEQ ID NO: 246857 - DNA, 23 bp, Artificial sequence
  SiRNA target sequence
gttttgtcataatcacgatttct

SEQ ID NO: 246858 - DNA, 23 bp, Artificial sequence
  SiRNA target sequence
ttttgtcataatcacgatttctc

SEQ ID NO: 246859 - DNA, 23 bp, Artificial sequence
  SiRNA target sequence
tttgtcataatcacgatttctct

SEQ ID NO: 246860 - DNA, 23 bp, Artificial sequence
  SiRNA target sequence
ttgtcataatcacgatttctctg

SEQ ID NO: 246861 - DNA, 23 bp, Artificial sequence
  SiRNA target sequence
tgtcataatcacgatttctctgt

SEQ ID NO: 246862 - DNA, 23 bp, Artificial sequence
  SiRNA target sequence
gtcataatcacgatttctctgta

SEQ ID NO: 246863 - DNA, 23 bp, Artificial sequence
  SiRNA target sequence
tcataatcacgatttctctgtaa

SEQ ID NO: 246864 - DNA, 23 bp, Artificial sequence
  SiRNA target sequence
cataatcacgatttctctgtaaa

SEQ ID NO: 246865 - DNA, 23 bp, Artificial sequence
  SiRNA target sequence
ataatcacgatttctctgtaaaa

SEQ ID NO: 246866 - DNA, 23 bp, Artificial sequence
  SiRNA target sequence
taatcacgatttctctgtaaaat

SEQ ID NO: 246867 - DNA, 23 bp, Artificial sequence
  SiRNA target sequence
aatcacgatttctctgtaaaatt

SEQ ID NO: 246868 - DNA, 23 bp, Artificial sequence
  SiRNA target sequence
atcacgatttctctgtaaaattc

SEQ ID NO: 246869 - DNA, 23 bp, Artificial sequence
  SiRNA target sequence
tcacgatttctctgtaaaattcc

SEQ ID NO: 246870 - DNA, 23 bp, Artificial sequence
  SiRNA target sequence
cacgatttctctgtaaaattcca

SEQ ID NO: 246871 - DNA, 23 bp, Artificial sequence
  SiRNA target sequence
acgatttctctgtaaaattccaa

SEQ ID NO: 246872 - DNA, 23 bp, Artificial sequence
  SiRNA target sequence
cgatttctctgtaaaattccaat

SEQ ID NO: 246873 - DNA, 23 bp, Artificial sequence
  SiRNA target sequence
gatttctctgtaaaattccaata

SEQ ID NO: 246874 - DNA, 23 bp, Artificial sequence
  SiRNA target sequence
atttctctgtaaaattccaataa

SEQ ID NO: 246875 - DNA, 23 bp, Artificial sequence
  SiRNA target sequence
tttctctgtaaaattccaataat

SEQ ID NO: 246876 - DNA, 23 bp, Artificial sequence
  SiRNA target sequence
ttctctgtaaaattccaataatg

SEQ ID NO: 246877 - DNA, 23 bp, Artificial sequence
  SiRNA target sequence
tctctgtaaaattccaataatgt

SEQ ID NO: 246878 - DNA, 23 bp, Artificial sequence
  SiRNA target sequence
ctctgtaaaattccaataatgtg

SEQ ID NO: 246879 - DNA, 23 bp, Artificial sequence
  SiRNA target sequence
tctgtaaaattccaataatgtgt

SEQ ID NO: 246880 - DNA, 23 bp, Artificial sequence
  SiRNA target sequence
ctgtaaaattccaataatgtgtt

SEQ ID NO: 246881 - DNA, 23 bp, Artificial sequence
  SiRNA target sequence
tgtaaaattccaataatgtgtta

SEQ ID NO: 246882 - DNA, 23 bp, Artificial sequence
  SiRNA target sequence
gtaaaattccaataatgtgttaa

SEQ ID NO: 246883 - DNA, 23 bp, Artificial sequence
  SiRNA target sequence
taaaattccaataatgtgttaat

SEQ ID NO: 246884 - DNA, 23 bp, Artificial sequence
  SiRNA target sequence
aaaattccaataatgtgttaatc

SEQ ID NO: 246885 - DNA, 23 bp, Artificial sequence
  SiRNA target sequence
aaattccaataatgtgttaatca

SEQ ID NO: 246886 - DNA, 23 bp, Artificial sequence
  SiRNA target sequence
aattccaataatgtgttaatcac

SEQ ID NO: 246887 - DNA, 23 bp, Artificial sequence
  SiRNA target sequence
attccaataatgtgttaatcaca

SEQ ID NO: 246888 - DNA, 23 bp, Artificial sequence
  SiRNA target sequence
ttccaataatgtgttaatcacac

SEQ ID NO: 246889 - DNA, 23 bp, Artificial sequence
  SiRNA target sequence
tccaataatgtgttaatcacaca

SEQ ID NO: 246890 - DNA, 23 bp, Artificial sequence
  SiRNA target sequence
ccaataatgtgttaatcacacat

SEQ ID NO: 246891 - DNA, 23 bp, Artificial sequence
  SiRNA target sequence
caataatgtgttaatcacacatg

SEQ ID NO: 246892 - DNA, 23 bp, Artificial sequence
  SiRNA target sequence
aataatgtgttaatcacacatgc

SEQ ID NO: 246893 - DNA, 23 bp, Artificial sequence
  SiRNA target sequence
ataatgtgttaatcacacatgcc

SEQ ID NO: 246894 - DNA, 23 bp, Artificial sequence
  SiRNA target sequence
taatgtgttaatcacacatgcca

SEQ ID NO: 246895 - DNA, 23 bp, Artificial sequence
  SiRNA target sequence
aatgtgttaatcacacatgccat

SEQ ID NO: 246896 - DNA, 23 bp, Artificial sequence
  SiRNA target sequence
atgtgttaatcacacatgccatt

SEQ ID NO: 246897 - DNA, 23 bp, Artificial sequence
  SiRNA target sequence
tgtgttaatcacacatgccatta

SEQ ID NO: 246898 - DNA, 23 bp, Artificial sequence
  SiRNA target sequence
gtgttaatcacacatgccattaa

SEQ ID NO: 246899 - DNA, 23 bp, Artificial sequence
  SiRNA target sequence
tgttaatcacacatgccattaaa

SEQ ID NO: 246900 - DNA, 23 bp, Artificial sequence
  SiRNA target sequence
gttaatcacacatgccattaaaa

SEQ ID NO: 246901 - DNA, 23 bp, Artificial sequence
  SiRNA target sequence
ttaatcacacatgccattaaaaa

SEQ ID NO: 246902 - DNA, 23 bp, Artificial sequence
  SiRNA target sequence
taatcacacatgccattaaaaat

SEQ ID NO: 246903 - DNA, 23 bp, Artificial sequence
  SiRNA target sequence
aatcacacatgccattaaaaatg

SEQ ID NO: 246904 - DNA, 23 bp, Artificial sequence
  SiRNA target sequence
atcacacatgccattaaaaatgt

SEQ ID NO: 246905 - DNA, 23 bp, Artificial sequence
  SiRNA target sequence
tcacacatgccattaaaaatgta

SEQ ID NO: 246906 - DNA, 23 bp, Artificial sequence
  SiRNA target sequence
cacacatgccattaaaaatgtaa

SEQ ID NO: 246907 - DNA, 23 bp, Artificial sequence
  SiRNA target sequence
acacatgccattaaaaatgtaag

SEQ ID NO: 246908 - DNA, 23 bp, Artificial sequence
  SiRNA target sequence
cacatgccattaaaaatgtaagt

SEQ ID NO: 246909 - DNA, 23 bp, Artificial sequence
  SiRNA target sequence
acatgccattaaaaatgtaagtg

SEQ ID NO: 246910 - DNA, 23 bp, Artificial sequence
  SiRNA target sequence
catgccattaaaaatgtaagtga

SEQ ID NO: 246911 - DNA, 23 bp, Artificial sequence
  SiRNA target sequence
atgccattaaaaatgtaagtgac

SEQ ID NO: 246912 - DNA, 23 bp, Artificial sequence
  SiRNA target sequence
tgccattaaaaatgtaagtgaca

SEQ ID NO: 246913 - DNA, 23 bp, Artificial sequence
  SiRNA target sequence
gccattaaaaatgtaagtgacaa

SEQ ID NO: 246914 - DNA, 23 bp, Artificial sequence
  SiRNA target sequence
ccattaaaaatgtaagtgacaat

SEQ ID NO: 246915 - DNA, 23 bp, Artificial sequence
  SiRNA target sequence
cattaaaaatgtaagtgacaata

SEQ ID NO: 246916 - DNA, 23 bp, Artificial sequence
  SiRNA target sequence
attaaaaatgtaagtgacaataa

SEQ ID NO: 246917 - DNA, 23 bp, Artificial sequence
  SiRNA target sequence
ttaaaaatgtaagtgacaataat

SEQ ID NO: 246918 - DNA, 23 bp, Artificial sequence
  SiRNA target sequence
taaaaatgtaagtgacaataata

SEQ ID NO: 246919 - DNA, 23 bp, Artificial sequence
  SiRNA target sequence
aaaaatgtaagtgacaataatat

SEQ ID NO: 246920 - DNA, 23 bp, Artificial sequence
  SiRNA target sequence
aaaatgtaagtgacaataatatt

SEQ ID NO: 246921 - DNA, 23 bp, Artificial sequence
  SiRNA target sequence
aaatgtaagtgacaataatattt

SEQ ID NO: 246922 - DNA, 23 bp, Artificial sequence
  SiRNA target sequence
aatgtaagtgacaataatatttt

SEQ ID NO: 246923 - DNA, 23 bp, Artificial sequence
  SiRNA target sequence
atgtaagtgacaataatattttt

SEQ ID NO: 246924 - DNA, 23 bp, Artificial sequence
  SiRNA target sequence
tgtaagtgacaataatattttta

SEQ ID NO: 246925 - DNA, 23 bp, Artificial sequence
  SiRNA target sequence
gtaagtgacaataatatttttac

SEQ ID NO: 246926 - DNA, 23 bp, Artificial sequence
  SiRNA target sequence
taagtgacaataatatttttact

SEQ ID NO: 246927 - DNA, 23 bp, Artificial sequence
  SiRNA target sequence
aagtgacaataatatttttactt

SEQ ID NO: 246928 - DNA, 23 bp, Artificial sequence
  SiRNA target sequence
agtgacaataatatttttacttt

SEQ ID NO: 246929 - DNA, 23 bp, Artificial sequence
  SiRNA target sequence
gtgacaataatatttttactttt

SEQ ID NO: 246930 - DNA, 23 bp, Artificial sequence
  SiRNA target sequence
tgacaataatatttttacttttg

SEQ ID NO: 246931 - DNA, 23 bp, Artificial sequence
  SiRNA target sequence
gacaataatatttttacttttgg

SEQ ID NO: 246932 - DNA, 23 bp, Artificial sequence
  SiRNA target sequence
acaataatatttttacttttggg

SEQ ID NO: 246933 - DNA, 23 bp, Artificial sequence
  SiRNA target sequence
caataatatttttacttttggga

SEQ ID NO: 246934 - DNA, 23 bp, Artificial sequence
  SiRNA target sequence
aataatatttttacttttgggaa

SEQ ID NO: 246935 - DNA, 23 bp, Artificial sequence
  SiRNA target sequence
ataatatttttacttttgggaat

SEQ ID NO: 246936 - DNA, 23 bp, Artificial sequence
  SiRNA target sequence
taatatttttacttttgggaatt

SEQ ID NO: 246937 - DNA, 23 bp, Artificial sequence
  SiRNA target sequence
aatatttttacttttgggaattt

SEQ ID NO: 246938 - DNA, 23 bp, Artificial sequence
  SiRNA target sequence
atatttttacttttgggaatttt

SEQ ID NO: 246939 - DNA, 23 bp, Artificial sequence
  SiRNA target sequence
tatttttacttttgggaattttt

SEQ ID NO: 246940 - DNA, 23 bp, Artificial sequence
  SiRNA target sequence
atttttacttttgggaatttttt

SEQ ID NO: 246941 - DNA, 23 bp, Artificial sequence
  SiRNA target sequence
tttttacttttgggaattttttt

SEQ ID NO: 246942 - DNA, 23 bp, Artificial sequence
  SiRNA target sequence
ttttacttttgggaatttttttg

SEQ ID NO: 246943 - DNA, 23 bp, Artificial sequence
  SiRNA target sequence
tttacttttgggaatttttttgt

SEQ ID NO: 246944 - DNA, 23 bp, Artificial sequence
  SiRNA target sequence
ttacttttgggaatttttttgtc

SEQ ID NO: 246945 - DNA, 23 bp, Artificial sequence
  SiRNA target sequence
tacttttgggaatttttttgtct

SEQ ID NO: 246946 - DNA, 23 bp, Artificial sequence
  SiRNA target sequence
acttttgggaatttttttgtctt

SEQ ID NO: 246947 - DNA, 23 bp, Artificial sequence
  SiRNA target sequence
cttttgggaatttttttgtctta

SEQ ID NO: 246948 - DNA, 23 bp, Artificial sequence
  SiRNA target sequence
ttttgggaatttttttgtcttag

SEQ ID NO: 246949 - DNA, 23 bp, Artificial sequence
  SiRNA target sequence
tttgggaatttttttgtcttagt

SEQ ID NO: 246950 - DNA, 23 bp, Artificial sequence
  SiRNA target sequence
ttgggaatttttttgtcttagtc

SEQ ID NO: 246951 - DNA, 23 bp, Artificial sequence
  SiRNA target sequence
tgggaatttttttgtcttagtca

SEQ ID NO: 246952 - DNA, 23 bp, Artificial sequence
  SiRNA target sequence
gggaatttttttgtcttagtcat

SEQ ID NO: 246953 - DNA, 24 bp, Artificial sequence
  SiRNA target sequence
ttaattaaaatcaacatctatctc

SEQ ID NO: 246954 - DNA, 24 bp, Artificial sequence
  SiRNA target sequence
taattaaaatcaacatctatctca

SEQ ID NO: 246955 - DNA, 24 bp, Artificial sequence
  SiRNA target sequence
aattaaaatcaacatctatctcag

SEQ ID NO: 246956 - DNA, 24 bp, Artificial sequence
  SiRNA target sequence
attaaaatcaacatctatctcaga

SEQ ID NO: 246957 - DNA, 24 bp, Artificial sequence
  SiRNA target sequence
ttaaaatcaacatctatctcagaa

SEQ ID NO: 246958 - DNA, 24 bp, Artificial sequence
  SiRNA target sequence
taaaatcaacatctatctcagaat

SEQ ID NO: 246959 - DNA, 24 bp, Artificial sequence
  SiRNA target sequence
aaaatcaacatctatctcagaatt

SEQ ID NO: 246960 - DNA, 24 bp, Artificial sequence
  SiRNA target sequence
aaatcaacatctatctcagaattt

SEQ ID NO: 246961 - DNA, 24 bp, Artificial sequence
  SiRNA target sequence
aatcaacatctatctcagaatttt

SEQ ID NO: 246962 - DNA, 24 bp, Artificial sequence
  SiRNA target sequence
atcaacatctatctcagaattttg

SEQ ID NO: 246963 - DNA, 24 bp, Artificial sequence
  SiRNA target sequence
tcaacatctatctcagaattttgt

SEQ ID NO: 246964 - DNA, 24 bp, Artificial sequence
  SiRNA target sequence
caacatctatctcagaattttgtt

SEQ ID NO: 246965 - DNA, 24 bp, Artificial sequence
  SiRNA target sequence
aacatctatctcagaattttgttc

SEQ ID NO: 246966 - DNA, 24 bp, Artificial sequence
  SiRNA target sequence
acatctatctcagaattttgttca

SEQ ID NO: 246967 - DNA, 24 bp, Artificial sequence
  SiRNA target sequence
catctatctcagaattttgttcaa

SEQ ID NO: 246968 - DNA, 24 bp, Artificial sequence
  SiRNA target sequence
atctatctcagaattttgttcaat

SEQ ID NO: 246969 - DNA, 24 bp, Artificial sequence
  SiRNA target sequence
tctatctcagaattttgttcaatt

SEQ ID NO: 246970 - DNA, 24 bp, Artificial sequence
  SiRNA target sequence
ctatctcagaattttgttcaattg

SEQ ID NO: 246971 - DNA, 24 bp, Artificial sequence
  SiRNA target sequence
tatctcagaattttgttcaattga

SEQ ID NO: 246972 - DNA, 24 bp, Artificial sequence
  SiRNA target sequence
atctcagaattttgttcaattgat

SEQ ID NO: 246973 - DNA, 24 bp, Artificial sequence
  SiRNA target sequence
tctcagaattttgttcaattgatt

SEQ ID NO: 246974 - DNA, 24 bp, Artificial sequence
  SiRNA target sequence
ctcagaattttgttcaattgattc

SEQ ID NO: 246975 - DNA, 24 bp, Artificial sequence
  SiRNA target sequence
tcagaattttgttcaattgattca

SEQ ID NO: 246976 - DNA, 24 bp, Artificial sequence
  SiRNA target sequence
cagaattttgttcaattgattcat

SEQ ID NO: 246977 - DNA, 24 bp, Artificial sequence
  SiRNA target sequence
agaattttgttcaattgattcatt

SEQ ID NO: 246978 - DNA, 24 bp, Artificial sequence
  SiRNA target sequence
gaattttgttcaattgattcatta

SEQ ID NO: 246979 - DNA, 24 bp, Artificial sequence
  SiRNA target sequence
aattttgttcaattgattcattat

SEQ ID NO: 246980 - DNA, 24 bp, Artificial sequence
  SiRNA target sequence
attttgttcaattgattcattata

SEQ ID NO: 246981 - DNA, 24 bp, Artificial sequence
  SiRNA target sequence
ttttgttcaattgattcattatat

SEQ ID NO: 246982 - DNA, 24 bp, Artificial sequence
  SiRNA target sequence
tttgttcaattgattcattatatt

SEQ ID NO: 246983 - DNA, 24 bp, Artificial sequence
  SiRNA target sequence
ttgttcaattgattcattatattt

SEQ ID NO: 246984 - DNA, 24 bp, Artificial sequence
  SiRNA target sequence
tgttcaattgattcattatatttt

SEQ ID NO: 246985 - DNA, 24 bp, Artificial sequence
  SiRNA target sequence
gttcaattgattcattatattttt

SEQ ID NO: 246986 - DNA, 24 bp, Artificial sequence
  SiRNA target sequence
ttcaattgattcattatatttttt

SEQ ID NO: 246987 - DNA, 24 bp, Artificial sequence
  SiRNA target sequence
tcaattgattcattatatttttta

SEQ ID NO: 246988 - DNA, 24 bp, Artificial sequence
  SiRNA target sequence
caattgattcattatattttttac

SEQ ID NO: 246989 - DNA, 24 bp, Artificial sequence
  SiRNA target sequence
aattgattcattatattttttact

SEQ ID NO: 246990 - DNA, 24 bp, Artificial sequence
  SiRNA target sequence
attgattcattatattttttactt

SEQ ID NO: 246991 - DNA, 24 bp, Artificial sequence
  SiRNA target sequence
ttgattcattatattttttactta

SEQ ID NO: 246992 - DNA, 24 bp, Artificial sequence
  SiRNA target sequence
tgattcattatattttttacttaa

SEQ ID NO: 246993 - DNA, 24 bp, Artificial sequence
  SiRNA target sequence
gattcattatattttttacttaaa

SEQ ID NO: 246994 - DNA, 24 bp, Artificial sequence
  SiRNA target sequence
attcattatattttttacttaaat

SEQ ID NO: 246995 - DNA, 24 bp, Artificial sequence
  SiRNA target sequence
ttcattatattttttacttaaata

SEQ ID NO: 246996 - DNA, 24 bp, Artificial sequence
  SiRNA target sequence
tcattatattttttacttaaataa

SEQ ID NO: 246997 - DNA, 24 bp, Artificial sequence
  SiRNA target sequence
cattatattttttacttaaataac

SEQ ID NO: 246998 - DNA, 24 bp, Artificial sequence
  SiRNA target sequence
attatattttttacttaaataaca

SEQ ID NO: 246999 - DNA, 24 bp, Artificial sequence
  SiRNA target sequence
ttatattttttacttaaataacag

SEQ ID NO: 247000 - DNA, 24 bp, Artificial sequence
  SiRNA target sequence
tatattttttacttaaataacaga

SEQ ID NO: 247001 - DNA, 24 bp, Artificial sequence
  SiRNA target sequence
atattttttacttaaataacagac

SEQ ID NO: 247002 - DNA, 24 bp, Artificial sequence
  SiRNA target sequence
tattttttacttaaataacagaca

SEQ ID NO: 247003 - DNA, 24 bp, Artificial sequence
  SiRNA target sequence
attttttacttaaataacagacac

SEQ ID NO: 247004 - DNA, 24 bp, Artificial sequence
  SiRNA target sequence
ttttttacttaaataacagacact

SEQ ID NO: 247005 - DNA, 24 bp, Artificial sequence
  SiRNA target sequence
tttttacttaaataacagacactc

SEQ ID NO: 247006 - DNA, 24 bp, Artificial sequence
  SiRNA target sequence
ttttacttaaataacagacactcc

SEQ ID NO: 247007 - DNA, 24 bp, Artificial sequence
  SiRNA target sequence
tttacttaaataacagacactcct

SEQ ID NO: 247008 - DNA, 24 bp, Artificial sequence
  SiRNA target sequence
ttacttaaataacagacactcctg

SEQ ID NO: 247009 - DNA, 24 bp, Artificial sequence
  SiRNA target sequence
tacttaaataacagacactcctga

SEQ ID NO: 247010 - DNA, 24 bp, Artificial sequence
  SiRNA target sequence
acttaaataacagacactcctgat

SEQ ID NO: 247011 - DNA, 24 bp, Artificial sequence
  SiRNA target sequence
cttaaataacagacactcctgatc

SEQ ID NO: 247012 - DNA, 24 bp, Artificial sequence
  SiRNA target sequence
ttaaataacagacactcctgatcc

SEQ ID NO: 247013 - DNA, 24 bp, Artificial sequence
  SiRNA target sequence
taaataacagacactcctgatcca

SEQ ID NO: 247014 - DNA, 24 bp, Artificial sequence
  SiRNA target sequence
aaataacagacactcctgatccac

SEQ ID NO: 247015 - DNA, 24 bp, Artificial sequence
  SiRNA target sequence
aataacagacactcctgatccaca

SEQ ID NO: 247016 - DNA, 24 bp, Artificial sequence
  SiRNA target sequence
ataacagacactcctgatccacaa

SEQ ID NO: 247017 - DNA, 24 bp, Artificial sequence
  SiRNA target sequence
taacagacactcctgatccacaaa

SEQ ID NO: 247018 - DNA, 24 bp, Artificial sequence
  SiRNA target sequence
aacagacactcctgatccacaaaa

SEQ ID NO: 247019 - DNA, 24 bp, Artificial sequence
  SiRNA target sequence
acagacactcctgatccacaaaaa

SEQ ID NO: 247020 - DNA, 24 bp, Artificial sequence
  SiRNA target sequence
cagacactcctgatccacaaaaaa

SEQ ID NO: 247021 - DNA, 24 bp, Artificial sequence
  SiRNA target sequence
agacactcctgatccacaaaaaat

SEQ ID NO: 247022 - DNA, 24 bp, Artificial sequence
  SiRNA target sequence
gacactcctgatccacaaaaaatt

SEQ ID NO: 247023 - DNA, 24 bp, Artificial sequence
  SiRNA target sequence
acactcctgatccacaaaaaattt

SEQ ID NO: 247024 - DNA, 24 bp, Artificial sequence
  SiRNA target sequence
cactcctgatccacaaaaaatttg

SEQ ID NO: 247025 - DNA, 24 bp, Artificial sequence
  SiRNA target sequence
actcctgatccacaaaaaatttgc

SEQ ID NO: 247026 - DNA, 24 bp, Artificial sequence
  SiRNA target sequence
ctcctgatccacaaaaaatttgca

SEQ ID NO: 247027 - DNA, 24 bp, Artificial sequence
  SiRNA target sequence
tcctgatccacaaaaaatttgcaa

SEQ ID NO: 247028 - DNA, 24 bp, Artificial sequence
  SiRNA target sequence
cctgatccacaaaaaatttgcaaa

SEQ ID NO: 247029 - DNA, 24 bp, Artificial sequence
  SiRNA target sequence
ctgatccacaaaaaatttgcaaat

SEQ ID NO: 247030 - DNA, 24 bp, Artificial sequence
  SiRNA target sequence
tgatccacaaaaaatttgcaaata

SEQ ID NO: 247031 - DNA, 24 bp, Artificial sequence
  SiRNA target sequence
gatccacaaaaaatttgcaaatat

SEQ ID NO: 247032 - DNA, 24 bp, Artificial sequence
  SiRNA target sequence
atccacaaaaaatttgcaaatatt

SEQ ID NO: 247033 - DNA, 24 bp, Artificial sequence
  SiRNA target sequence
tccacaaaaaatttgcaaatatta

SEQ ID NO: 247034 - DNA, 24 bp, Artificial sequence
  SiRNA target sequence
ccacaaaaaatttgcaaatattaa

SEQ ID NO: 247035 - DNA, 24 bp, Artificial sequence
  SiRNA target sequence
cacaaaaaatttgcaaatattaaa

SEQ ID NO: 247036 - DNA, 24 bp, Artificial sequence
  SiRNA target sequence
acaaaaaatttgcaaatattaaaa

SEQ ID NO: 247037 - DNA, 24 bp, Artificial sequence
  SiRNA target sequence
caaaaaatttgcaaatattaaaaa

SEQ ID NO: 247038 - DNA, 24 bp, Artificial sequence
  SiRNA target sequence
aaaaaatttgcaaatattaaaaat

SEQ ID NO: 247039 - DNA, 24 bp, Artificial sequence
  SiRNA target sequence
aaaaatttgcaaatattaaaaata

SEQ ID NO: 247040 - DNA, 24 bp, Artificial sequence
  SiRNA target sequence
aaaatttgcaaatattaaaaatat

SEQ ID NO: 247041 - DNA, 24 bp, Artificial sequence
  SiRNA target sequence
aaatttgcaaatattaaaaatata

SEQ ID NO: 247042 - DNA, 24 bp, Artificial sequence
  SiRNA target sequence
aatttgcaaatattaaaaatataa

SEQ ID NO: 247043 - DNA, 24 bp, Artificial sequence
  SiRNA target sequence
atttgcaaatattaaaaatataaa

SEQ ID NO: 247044 - DNA, 24 bp, Artificial sequence
  SiRNA target sequence
tttgcaaatattaaaaatataaaa

SEQ ID NO: 247045 - DNA, 24 bp, Artificial sequence
  SiRNA target sequence
ttgcaaatattaaaaatataaaag

SEQ ID NO: 247046 - DNA, 24 bp, Artificial sequence
  SiRNA target sequence
tgcaaatattaaaaatataaaaga

SEQ ID NO: 247047 - DNA, 24 bp, Artificial sequence
  SiRNA target sequence
gcaaatattaaaaatataaaagac

SEQ ID NO: 247048 - DNA, 24 bp, Artificial sequence
  SiRNA target sequence
caaatattaaaaatataaaagaca

SEQ ID NO: 247049 - DNA, 24 bp, Artificial sequence
  SiRNA target sequence
aaatattaaaaatataaaagacac

SEQ ID NO: 247050 - DNA, 24 bp, Artificial sequence
  SiRNA target sequence
aatattaaaaatataaaagacacg

SEQ ID NO: 247051 - DNA, 24 bp, Artificial sequence
  SiRNA target sequence
atattaaaaatataaaagacacgt

SEQ ID NO: 247052 - DNA, 24 bp, Artificial sequence
  SiRNA target sequence
tattaaaaatataaaagacacgta

SEQ ID NO: 247053 - DNA, 24 bp, Artificial sequence
  SiRNA target sequence
attaaaaatataaaagacacgtat

SEQ ID NO: 247054 - DNA, 24 bp, Artificial sequence
  SiRNA target sequence
ttaaaaatataaaagacacgtatg

SEQ ID NO: 247055 - DNA, 24 bp, Artificial sequence
  SiRNA target sequence
taaaaatataaaagacacgtatga

SEQ ID NO: 247056 - DNA, 24 bp, Artificial sequence
  SiRNA target sequence
aaaaatataaaagacacgtatgat

SEQ ID NO: 247057 - DNA, 24 bp, Artificial sequence
  SiRNA target sequence
aaaatataaaagacacgtatgata

SEQ ID NO: 247058 - DNA, 24 bp, Artificial sequence
  SiRNA target sequence
aaatataaaagacacgtatgatac

SEQ ID NO: 247059 - DNA, 24 bp, Artificial sequence
  SiRNA target sequence
aatataaaagacacgtatgatact

SEQ ID NO: 247060 - DNA, 24 bp, Artificial sequence
  SiRNA target sequence
atataaaagacacgtatgatactt

SEQ ID NO: 247061 - DNA, 24 bp, Artificial sequence
  SiRNA target sequence
tataaaagacacgtatgatacttg

SEQ ID NO: 247062 - DNA, 24 bp, Artificial sequence
  SiRNA target sequence
ataaaagacacgtatgatacttgt

SEQ ID NO: 247063 - DNA, 24 bp, Artificial sequence
  SiRNA target sequence
taaaagacacgtatgatacttgtc

SEQ ID NO: 247064 - DNA, 24 bp, Artificial sequence
  SiRNA target sequence
aaaagacacgtatgatacttgtct

SEQ ID NO: 247065 - DNA, 24 bp, Artificial sequence
  SiRNA target sequence
aaagacacgtatgatacttgtcta

SEQ ID NO: 247066 - DNA, 24 bp, Artificial sequence
  SiRNA target sequence
aagacacgtatgatacttgtctaa

SEQ ID NO: 247067 - DNA, 24 bp, Artificial sequence
  SiRNA target sequence
agacacgtatgatacttgtctaat

SEQ ID NO: 247068 - DNA, 24 bp, Artificial sequence
  SiRNA target sequence
gacacgtatgatacttgtctaata

SEQ ID NO: 247069 - DNA, 24 bp, Artificial sequence
  SiRNA target sequence
acacgtatgatacttgtctaatat

SEQ ID NO: 247070 - DNA, 24 bp, Artificial sequence
  SiRNA target sequence
cacgtatgatacttgtctaatatc

SEQ ID NO: 247071 - DNA, 24 bp, Artificial sequence
  SiRNA target sequence
acgtatgatacttgtctaatatct

SEQ ID NO: 247072 - DNA, 24 bp, Artificial sequence
  SiRNA target sequence
cgtatgatacttgtctaatatctg

SEQ ID NO: 247073 - DNA, 24 bp, Artificial sequence
  SiRNA target sequence
gtatgatacttgtctaatatctgg

SEQ ID NO: 247074 - DNA, 24 bp, Artificial sequence
  SiRNA target sequence
tatgatacttgtctaatatctgga

SEQ ID NO: 247075 - DNA, 24 bp, Artificial sequence
  SiRNA target sequence
atgatacttgtctaatatctggaa

SEQ ID NO: 247076 - DNA, 24 bp, Artificial sequence
  SiRNA target sequence
tgatacttgtctaatatctggaat

SEQ ID NO: 247077 - DNA, 24 bp, Artificial sequence
  SiRNA target sequence
gatacttgtctaatatctggaatt

SEQ ID NO: 247078 - DNA, 24 bp, Artificial sequence
  SiRNA target sequence
atacttgtctaatatctggaattt

SEQ ID NO: 247079 - DNA, 24 bp, Artificial sequence
  SiRNA target sequence
tacttgtctaatatctggaatttc

SEQ ID NO: 247080 - DNA, 24 bp, Artificial sequence
  SiRNA target sequence
acttgtctaatatctggaatttct

SEQ ID NO: 247081 - DNA, 24 bp, Artificial sequence
  SiRNA target sequence
cttgtctaatatctggaatttcta

SEQ ID NO: 247082 - DNA, 24 bp, Artificial sequence
  SiRNA target sequence
ttgtctaatatctggaatttctat

SEQ ID NO: 247083 - DNA, 24 bp, Artificial sequence
  SiRNA target sequence
tgtctaatatctggaatttctata

SEQ ID NO: 247084 - DNA, 24 bp, Artificial sequence
  SiRNA target sequence
gtctaatatctggaatttctataa

SEQ ID NO: 247085 - DNA, 24 bp, Artificial sequence
  SiRNA target sequence
tctaatatctggaatttctataaa

SEQ ID NO: 247086 - DNA, 24 bp, Artificial sequence
  SiRNA target sequence
ctaatatctggaatttctataaac

SEQ ID NO: 247087 - DNA, 24 bp, Artificial sequence
  SiRNA target sequence
taatatctggaatttctataaacg

SEQ ID NO: 247088 - DNA, 24 bp, Artificial sequence
  SiRNA target sequence
aatatctggaatttctataaacgt

SEQ ID NO: 247089 - DNA, 24 bp, Artificial sequence
  SiRNA target sequence
atatctggaatttctataaacgtc

SEQ ID NO: 247090 - DNA, 24 bp, Artificial sequence
  SiRNA target sequence
tatctggaatttctataaacgtca

SEQ ID NO: 247091 - DNA, 24 bp, Artificial sequence
  SiRNA target sequence
atctggaatttctataaacgtcaa

SEQ ID NO: 247092 - DNA, 24 bp, Artificial sequence
  SiRNA target sequence
tctggaatttctataaacgtcaaa

SEQ ID NO: 247093 - DNA, 24 bp, Artificial sequence
  SiRNA target sequence
ctggaatttctataaacgtcaaaa

SEQ ID NO: 247094 - DNA, 24 bp, Artificial sequence
  SiRNA target sequence
tggaatttctataaacgtcaaaaa

SEQ ID NO: 247095 - DNA, 24 bp, Artificial sequence
  SiRNA target sequence
ggaatttctataaacgtcaaaaaa

SEQ ID NO: 247096 - DNA, 24 bp, Artificial sequence
  SiRNA target sequence
gaatttctataaacgtcaaaaaag

SEQ ID NO: 247097 - DNA, 24 bp, Artificial sequence
  SiRNA target sequence
aatttctataaacgtcaaaaaagt

SEQ ID NO: 247098 - DNA, 24 bp, Artificial sequence
  SiRNA target sequence
atttctataaacgtcaaaaaagtt

SEQ ID NO: 247099 - DNA, 24 bp, Artificial sequence
  SiRNA target sequence
tttctataaacgtcaaaaaagttc

SEQ ID NO: 247100 - DNA, 24 bp, Artificial sequence
  SiRNA target sequence
ttctataaacgtcaaaaaagttcc

SEQ ID NO: 247101 - DNA, 24 bp, Artificial sequence
  SiRNA target sequence
tctataaacgtcaaaaaagttcca

SEQ ID NO: 247102 - DNA, 24 bp, Artificial sequence
  SiRNA target sequence
ctataaacgtcaaaaaagttccat

SEQ ID NO: 247103 - DNA, 24 bp, Artificial sequence
  SiRNA target sequence
tataaacgtcaaaaaagttccata

SEQ ID NO: 247104 - DNA, 24 bp, Artificial sequence
  SiRNA target sequence
ataaacgtcaaaaaagttccatat

SEQ ID NO: 247105 - DNA, 24 bp, Artificial sequence
  SiRNA target sequence
taaacgtcaaaaaagttccatata

SEQ ID NO: 247106 - DNA, 24 bp, Artificial sequence
  SiRNA target sequence
aaacgtcaaaaaagttccatataa

SEQ ID NO: 247107 - DNA, 24 bp, Artificial sequence
  SiRNA target sequence
aacgtcaaaaaagttccatataaa

SEQ ID NO: 247108 - DNA, 24 bp, Artificial sequence
  SiRNA target sequence
acgtcaaaaaagttccatataaag

SEQ ID NO: 247109 - DNA, 24 bp, Artificial sequence
  SiRNA target sequence
cgtcaaaaaagttccatataaaga

SEQ ID NO: 247110 - DNA, 24 bp, Artificial sequence
  SiRNA target sequence
gtcaaaaaagttccatataaagag

SEQ ID NO: 247111 - DNA, 24 bp, Artificial sequence
  SiRNA target sequence
tcaaaaaagttccatataaagaga

SEQ ID NO: 247112 - DNA, 24 bp, Artificial sequence
  SiRNA target sequence
caaaaaagttccatataaagagat

SEQ ID NO: 247113 - DNA, 24 bp, Artificial sequence
  SiRNA target sequence
aaaaaagttccatataaagagata

SEQ ID NO: 247114 - DNA, 24 bp, Artificial sequence
  SiRNA target sequence
aaaaagttccatataaagagataa

SEQ ID NO: 247115 - DNA, 24 bp, Artificial sequence
  SiRNA target sequence
aaaagttccatataaagagataat

SEQ ID NO: 247116 - DNA, 24 bp, Artificial sequence
  SiRNA target sequence
aaagttccatataaagagataata

SEQ ID NO: 247117 - DNA, 24 bp, Artificial sequence
  SiRNA target sequence
aagttccatataaagagataatag

SEQ ID NO: 247118 - DNA, 24 bp, Artificial sequence
  SiRNA target sequence
agttccatataaagagataataga

SEQ ID NO: 247119 - DNA, 24 bp, Artificial sequence
  SiRNA target sequence
gttccatataaagagataatagat

SEQ ID NO: 247120 - DNA, 24 bp, Artificial sequence
  SiRNA target sequence
ttccatataaagagataatagatt

SEQ ID NO: 247121 - DNA, 24 bp, Artificial sequence
  SiRNA target sequence
tccatataaagagataatagattt

SEQ ID NO: 247122 - DNA, 24 bp, Artificial sequence
  SiRNA target sequence
ccatataaagagataatagattta

SEQ ID NO: 247123 - DNA, 24 bp, Artificial sequence
  SiRNA target sequence
catataaagagataatagatttac

SEQ ID NO: 247124 - DNA, 24 bp, Artificial sequence
  SiRNA target sequence
atataaagagataatagatttacc

SEQ ID NO: 247125 - DNA, 24 bp, Artificial sequence
  SiRNA target sequence
tataaagagataatagatttacca

SEQ ID NO: 247126 - DNA, 24 bp, Artificial sequence
  SiRNA target sequence
ataaagagataatagatttaccaa

SEQ ID NO: 247127 - DNA, 24 bp, Artificial sequence
  SiRNA target sequence
taaagagataatagatttaccaat

SEQ ID NO: 247128 - DNA, 24 bp, Artificial sequence
  SiRNA target sequence
aaagagataatagatttaccaatt

SEQ ID NO: 247129 - DNA, 24 bp, Artificial sequence
  SiRNA target sequence
aagagataatagatttaccaattt

SEQ ID NO: 247130 - DNA, 24 bp, Artificial sequence
  SiRNA target sequence
agagataatagatttaccaatttt

SEQ ID NO: 247131 - DNA, 24 bp, Artificial sequence
  SiRNA target sequence
gagataatagatttaccaattttg

SEQ ID NO: 247132 - DNA, 24 bp, Artificial sequence
  SiRNA target sequence
agataatagatttaccaattttga

SEQ ID NO: 247133 - DNA, 24 bp, Artificial sequence
  SiRNA target sequence
gataatagatttaccaattttgat

SEQ ID NO: 247134 - DNA, 24 bp, Artificial sequence
  SiRNA target sequence
ataatagatttaccaattttgata

SEQ ID NO: 247135 - DNA, 24 bp, Artificial sequence
  SiRNA target sequence
taatagatttaccaattttgatac

SEQ ID NO: 247136 - DNA, 24 bp, Artificial sequence
  SiRNA target sequence
aatagatttaccaattttgataca

SEQ ID NO: 247137 - DNA, 24 bp, Artificial sequence
  SiRNA target sequence
atagatttaccaattttgatacat

SEQ ID NO: 247138 - DNA, 24 bp, Artificial sequence
  SiRNA target sequence
tagatttaccaattttgatacata

SEQ ID NO: 247139 - DNA, 24 bp, Artificial sequence
  SiRNA target sequence
agatttaccaattttgatacatac

SEQ ID NO: 247140 - DNA, 24 bp, Artificial sequence
  SiRNA target sequence
gatttaccaattttgatacataca

SEQ ID NO: 247141 - DNA, 24 bp, Artificial sequence
  SiRNA target sequence
atttaccaattttgatacatacac

SEQ ID NO: 247142 - DNA, 24 bp, Artificial sequence
  SiRNA target sequence
tttaccaattttgatacatacacc

SEQ ID NO: 247143 - DNA, 24 bp, Artificial sequence
  SiRNA target sequence
ttaccaattttgatacatacacca

SEQ ID NO: 247144 - DNA, 24 bp, Artificial sequence
  SiRNA target sequence
taccaattttgatacatacaccat

SEQ ID NO: 247145 - DNA, 24 bp, Artificial sequence
  SiRNA target sequence
accaattttgatacatacaccatc

SEQ ID NO: 247146 - DNA, 24 bp, Artificial sequence
  SiRNA target sequence
ccaattttgatacatacaccatca

SEQ ID NO: 247147 - DNA, 24 bp, Artificial sequence
  SiRNA target sequence
caattttgatacatacaccatcat

SEQ ID NO: 247148 - DNA, 24 bp, Artificial sequence
  SiRNA target sequence
aattttgatacatacaccatcata

SEQ ID NO: 247149 - DNA, 24 bp, Artificial sequence
  SiRNA target sequence
attttgatacatacaccatcataa

SEQ ID NO: 247150 - DNA, 24 bp, Artificial sequence
  SiRNA target sequence
ttttgatacatacaccatcataaa

SEQ ID NO: 247151 - DNA, 24 bp, Artificial sequence
  SiRNA target sequence
tttgatacatacaccatcataaaa

SEQ ID NO: 247152 - DNA, 24 bp, Artificial sequence
  SiRNA target sequence
ttgatacatacaccatcataaaaa

SEQ ID NO: 247153 - DNA, 24 bp, Artificial sequence
  SiRNA target sequence
tgatacatacaccatcataaaaac

SEQ ID NO: 247154 - DNA, 24 bp, Artificial sequence
  SiRNA target sequence
gatacatacaccatcataaaaact

SEQ ID NO: 247155 - DNA, 24 bp, Artificial sequence
  SiRNA target sequence
atacatacaccatcataaaaactt

SEQ ID NO: 247156 - DNA, 24 bp, Artificial sequence
  SiRNA target sequence
tacatacaccatcataaaaacttt

SEQ ID NO: 247157 - DNA, 24 bp, Artificial sequence
  SiRNA target sequence
acatacaccatcataaaaactttt

SEQ ID NO: 247158 - DNA, 24 bp, Artificial sequence
  SiRNA target sequence
catacaccatcataaaaactttta

SEQ ID NO: 247159 - DNA, 24 bp, Artificial sequence
  SiRNA target sequence
atacaccatcataaaaacttttaa

SEQ ID NO: 247160 - DNA, 24 bp, Artificial sequence
  SiRNA target sequence
tacaccatcataaaaacttttaaa

SEQ ID NO: 247161 - DNA, 24 bp, Artificial sequence
  SiRNA target sequence
acaccatcataaaaacttttaaat

SEQ ID NO: 247162 - DNA, 24 bp, Artificial sequence
  SiRNA target sequence
caccatcataaaaacttttaaatt

SEQ ID NO: 247163 - DNA, 24 bp, Artificial sequence
  SiRNA target sequence
accatcataaaaacttttaaattt

SEQ ID NO: 247164 - DNA, 24 bp, Artificial sequence
  SiRNA target sequence
ccatcataaaaacttttaaattta

SEQ ID NO: 247165 - DNA, 24 bp, Artificial sequence
  SiRNA target sequence
catcataaaaacttttaaatttat

SEQ ID NO: 247166 - DNA, 24 bp, Artificial sequence
  SiRNA target sequence
atcataaaaacttttaaatttata

SEQ ID NO: 247167 - DNA, 24 bp, Artificial sequence
  SiRNA target sequence
tcataaaaacttttaaatttatac

SEQ ID NO: 247168 - DNA, 24 bp, Artificial sequence
  SiRNA target sequence
cataaaaacttttaaatttatacc

SEQ ID NO: 247169 - DNA, 24 bp, Artificial sequence
  SiRNA target sequence
ataaaaacttttaaatttatacct

SEQ ID NO: 247170 - DNA, 24 bp, Artificial sequence
  SiRNA target sequence
taaaaacttttaaatttatacctg

SEQ ID NO: 247171 - DNA, 24 bp, Artificial sequence
  SiRNA target sequence
aaaaacttttaaatttatacctgt

SEQ ID NO: 247172 - DNA, 24 bp, Artificial sequence
  SiRNA target sequence
aaaacttttaaatttatacctgta

SEQ ID NO: 247173 - DNA, 24 bp, Artificial sequence
  SiRNA target sequence
aaacttttaaatttatacctgtat

SEQ ID NO: 247174 - DNA, 24 bp, Artificial sequence
  SiRNA target sequence
aacttttaaatttatacctgtatt

SEQ ID NO: 247175 - DNA, 24 bp, Artificial sequence
  SiRNA target sequence
acttttaaatttatacctgtattt

SEQ ID NO: 247176 - DNA, 24 bp, Artificial sequence
  SiRNA target sequence
cttttaaatttatacctgtattta

SEQ ID NO: 247177 - DNA, 24 bp, Artificial sequence
  SiRNA target sequence
ttttaaatttatacctgtatttaa

SEQ ID NO: 247178 - DNA, 24 bp, Artificial sequence
  SiRNA target sequence
tttaaatttatacctgtatttaac

SEQ ID NO: 247179 - DNA, 24 bp, Artificial sequence
  SiRNA target sequence
ttaaatttatacctgtatttaaca

SEQ ID NO: 247180 - DNA, 24 bp, Artificial sequence
  SiRNA target sequence
taaatttatacctgtatttaacag

SEQ ID NO: 247181 - DNA, 24 bp, Artificial sequence
  SiRNA target sequence
aaatttatacctgtatttaacagg

SEQ ID NO: 247182 - DNA, 24 bp, Artificial sequence
  SiRNA target sequence
aatttatacctgtatttaacaggc

SEQ ID NO: 247183 - DNA, 24 bp, Artificial sequence
  SiRNA target sequence
atttatacctgtatttaacaggca

SEQ ID NO: 247184 - DNA, 24 bp, Artificial sequence
  SiRNA target sequence
tttatacctgtatttaacaggcac

SEQ ID NO: 247185 - DNA, 24 bp, Artificial sequence
  SiRNA target sequence
ttatacctgtatttaacaggcacc

SEQ ID NO: 247186 - DNA, 24 bp, Artificial sequence
  SiRNA target sequence
tatacctgtatttaacaggcaccc

SEQ ID NO: 247187 - DNA, 24 bp, Artificial sequence
  SiRNA target sequence
atacctgtatttaacaggcaccct

SEQ ID NO: 247188 - DNA, 24 bp, Artificial sequence
  SiRNA target sequence
tacctgtatttaacaggcaccctc

SEQ ID NO: 247189 - DNA, 24 bp, Artificial sequence
  SiRNA target sequence
acctgtatttaacaggcaccctca

SEQ ID NO: 247190 - DNA, 24 bp, Artificial sequence
  SiRNA target sequence
cctgtatttaacaggcaccctcat

SEQ ID NO: 247191 - DNA, 24 bp, Artificial sequence
  SiRNA target sequence
ctgtatttaacaggcaccctcata

SEQ ID NO: 247192 - DNA, 24 bp, Artificial sequence
  SiRNA target sequence
tgtatttaacaggcaccctcatag

SEQ ID NO: 247193 - DNA, 24 bp, Artificial sequence
  SiRNA target sequence
gtatttaacaggcaccctcataga

SEQ ID NO: 247194 - DNA, 24 bp, Artificial sequence
  SiRNA target sequence
tatttaacaggcaccctcatagaa

SEQ ID NO: 247195 - DNA, 24 bp, Artificial sequence
  SiRNA target sequence
atttaacaggcaccctcatagaaa

SEQ ID NO: 247196 - DNA, 24 bp, Artificial sequence
  SiRNA target sequence
tttaacaggcaccctcatagaaag

SEQ ID NO: 247197 - DNA, 24 bp, Artificial sequence
  SiRNA target sequence
ttaacaggcaccctcatagaaagc

SEQ ID NO: 247198 - DNA, 24 bp, Artificial sequence
  SiRNA target sequence
taacaggcaccctcatagaaagca

SEQ ID NO: 247199 - DNA, 24 bp, Artificial sequence
  SiRNA target sequence
aacaggcaccctcatagaaagcat

SEQ ID NO: 247200 - DNA, 24 bp, Artificial sequence
  SiRNA target sequence
acaggcaccctcatagaaagcatt

SEQ ID NO: 247201 - DNA, 24 bp, Artificial sequence
  SiRNA target sequence
caggcaccctcatagaaagcattt

SEQ ID NO: 247202 - DNA, 24 bp, Artificial sequence
  SiRNA target sequence
aggcaccctcatagaaagcatttc

SEQ ID NO: 247203 - DNA, 24 bp, Artificial sequence
  SiRNA target sequence
ggcaccctcatagaaagcatttct

SEQ ID NO: 247204 - DNA, 24 bp, Artificial sequence
  SiRNA target sequence
gcaccctcatagaaagcatttctt

SEQ ID NO: 247205 - DNA, 24 bp, Artificial sequence
  SiRNA target sequence
caccctcatagaaagcatttcttt

SEQ ID NO: 247206 - DNA, 24 bp, Artificial sequence
  SiRNA target sequence
accctcatagaaagcatttctttt

SEQ ID NO: 247207 - DNA, 24 bp, Artificial sequence
  SiRNA target sequence
ccctcatagaaagcatttcttttg

SEQ ID NO: 247208 - DNA, 24 bp, Artificial sequence
  SiRNA target sequence
cctcatagaaagcatttcttttgc

SEQ ID NO: 247209 - DNA, 24 bp, Artificial sequence
  SiRNA target sequence
ctcatagaaagcatttcttttgct

SEQ ID NO: 247210 - DNA, 24 bp, Artificial sequence
  SiRNA target sequence
tcatagaaagcatttcttttgcta

SEQ ID NO: 247211 - DNA, 24 bp, Artificial sequence
  SiRNA target sequence
catagaaagcatttcttttgctaa

SEQ ID NO: 247212 - DNA, 24 bp, Artificial sequence
  SiRNA target sequence
atagaaagcatttcttttgctaaa

SEQ ID NO: 247213 - DNA, 24 bp, Artificial sequence
  SiRNA target sequence
tagaaagcatttcttttgctaaat

SEQ ID NO: 247214 - DNA, 24 bp, Artificial sequence
  SiRNA target sequence
agaaagcatttcttttgctaaatc

SEQ ID NO: 247215 - DNA, 24 bp, Artificial sequence
  SiRNA target sequence
gaaagcatttcttttgctaaatca

SEQ ID NO: 247216 - DNA, 24 bp, Artificial sequence
  SiRNA target sequence
aaagcatttcttttgctaaatcaa

SEQ ID NO: 247217 - DNA, 24 bp, Artificial sequence
  SiRNA target sequence
aagcatttcttttgctaaatcaaa

SEQ ID NO: 247218 - DNA, 24 bp, Artificial sequence
  SiRNA target sequence
agcatttcttttgctaaatcaaat

SEQ ID NO: 247219 - DNA, 24 bp, Artificial sequence
  SiRNA target sequence
gcatttcttttgctaaatcaaata

SEQ ID NO: 247220 - DNA, 24 bp, Artificial sequence
  SiRNA target sequence
catttcttttgctaaatcaaataa

SEQ ID NO: 247221 - DNA, 24 bp, Artificial sequence
  SiRNA target sequence
atttcttttgctaaatcaaataaa

SEQ ID NO: 247222 - DNA, 24 bp, Artificial sequence
  SiRNA target sequence
tttcttttgctaaatcaaataaaa

SEQ ID NO: 247223 - DNA, 24 bp, Artificial sequence
  SiRNA target sequence
ttcttttgctaaatcaaataaaac

SEQ ID NO: 247224 - DNA, 24 bp, Artificial sequence
  SiRNA target sequence
tcttttgctaaatcaaataaaaca

SEQ ID NO: 247225 - DNA, 24 bp, Artificial sequence
  SiRNA target sequence
cttttgctaaatcaaataaaacat

SEQ ID NO: 247226 - DNA, 24 bp, Artificial sequence
  SiRNA target sequence
ttttgctaaatcaaataaaacata

SEQ ID NO: 247227 - DNA, 24 bp, Artificial sequence
  SiRNA target sequence
tttgctaaatcaaataaaacatat

SEQ ID NO: 247228 - DNA, 24 bp, Artificial sequence
  SiRNA target sequence
ttgctaaatcaaataaaacatatt

SEQ ID NO: 247229 - DNA, 24 bp, Artificial sequence
  SiRNA target sequence
tgctaaatcaaataaaacatattt

SEQ ID NO: 247230 - DNA, 24 bp, Artificial sequence
  SiRNA target sequence
gctaaatcaaataaaacatatttg

SEQ ID NO: 247231 - DNA, 24 bp, Artificial sequence
  SiRNA target sequence
ctaaatcaaataaaacatatttgg

SEQ ID NO: 247232 - DNA, 24 bp, Artificial sequence
  SiRNA target sequence
taaatcaaataaaacatatttggt

SEQ ID NO: 247233 - DNA, 24 bp, Artificial sequence
  SiRNA target sequence
aaatcaaataaaacatatttggta

SEQ ID NO: 247234 - DNA, 24 bp, Artificial sequence
  SiRNA target sequence
aatcaaataaaacatatttggtaa

SEQ ID NO: 247235 - DNA, 24 bp, Artificial sequence
  SiRNA target sequence
atcaaataaaacatatttggtaat

SEQ ID NO: 247236 - DNA, 24 bp, Artificial sequence
  SiRNA target sequence
tcaaataaaacatatttggtaatt

SEQ ID NO: 247237 - DNA, 24 bp, Artificial sequence
  SiRNA target sequence
caaataaaacatatttggtaattt

SEQ ID NO: 247238 - DNA, 24 bp, Artificial sequence
  SiRNA target sequence
aaataaaacatatttggtaatttt

SEQ ID NO: 247239 - DNA, 24 bp, Artificial sequence
  SiRNA target sequence
aataaaacatatttggtaatttta

SEQ ID NO: 247240 - DNA, 24 bp, Artificial sequence
  SiRNA target sequence
ataaaacatatttggtaattttag

SEQ ID NO: 247241 - DNA, 24 bp, Artificial sequence
  SiRNA target sequence
taaaacatatttggtaattttaga

SEQ ID NO: 247242 - DNA, 24 bp, Artificial sequence
  SiRNA target sequence
aaaacatatttggtaattttagaa

SEQ ID NO: 247243 - DNA, 24 bp, Artificial sequence
  SiRNA target sequence
aaacatatttggtaattttagaaa

SEQ ID NO: 247244 - DNA, 24 bp, Artificial sequence
  SiRNA target sequence
aacatatttggtaattttagaaaa

SEQ ID NO: 247245 - DNA, 24 bp, Artificial sequence
  SiRNA target sequence
acatatttggtaattttagaaaat

SEQ ID NO: 247246 - DNA, 24 bp, Artificial sequence
  SiRNA target sequence
catatttggtaattttagaaaatg

SEQ ID NO: 247247 - DNA, 24 bp, Artificial sequence
  SiRNA target sequence
atatttggtaattttagaaaatgc

SEQ ID NO: 247248 - DNA, 24 bp, Artificial sequence
  SiRNA target sequence
tatttggtaattttagaaaatgca

SEQ ID NO: 247249 - DNA, 24 bp, Artificial sequence
  SiRNA target sequence
atttggtaattttagaaaatgcaa

SEQ ID NO: 247250 - DNA, 24 bp, Artificial sequence
  SiRNA target sequence
tttggtaattttagaaaatgcaaa

SEQ ID NO: 247251 - DNA, 24 bp, Artificial sequence
  SiRNA target sequence
ttggtaattttagaaaatgcaaat

SEQ ID NO: 247252 - DNA, 24 bp, Artificial sequence
  SiRNA target sequence
tggtaattttagaaaatgcaaatc

SEQ ID NO: 247253 - DNA, 24 bp, Artificial sequence
  SiRNA target sequence
ggtaattttagaaaatgcaaatcc

SEQ ID NO: 247254 - DNA, 24 bp, Artificial sequence
  SiRNA target sequence
gtaattttagaaaatgcaaatcca

SEQ ID NO: 247255 - DNA, 24 bp, Artificial sequence
  SiRNA target sequence
taattttagaaaatgcaaatccaa

SEQ ID NO: 247256 - DNA, 24 bp, Artificial sequence
  SiRNA target sequence
aattttagaaaatgcaaatccaat

SEQ ID NO: 247257 - DNA, 24 bp, Artificial sequence
  SiRNA target sequence
attttagaaaatgcaaatccaatg

SEQ ID NO: 247258 - DNA, 24 bp, Artificial sequence
  SiRNA target sequence
ttttagaaaatgcaaatccaatgg

SEQ ID NO: 247259 - DNA, 24 bp, Artificial sequence
  SiRNA target sequence
tttagaaaatgcaaatccaatggt

SEQ ID NO: 247260 - DNA, 24 bp, Artificial sequence
  SiRNA target sequence
ttagaaaatgcaaatccaatggtt

SEQ ID NO: 247261 - DNA, 24 bp, Artificial sequence
  SiRNA target sequence
tagaaaatgcaaatccaatggttg

SEQ ID NO: 247262 - DNA, 24 bp, Artificial sequence
  SiRNA target sequence
agaaaatgcaaatccaatggttgc

SEQ ID NO: 247263 - DNA, 24 bp, Artificial sequence
  SiRNA target sequence
gaaaatgcaaatccaatggttgca

SEQ ID NO: 247264 - DNA, 24 bp, Artificial sequence
  SiRNA target sequence
aaaatgcaaatccaatggttgcac

SEQ ID NO: 247265 - DNA, 24 bp, Artificial sequence
  SiRNA target sequence
aaatgcaaatccaatggttgcaca

SEQ ID NO: 247266 - DNA, 24 bp, Artificial sequence
  SiRNA target sequence
aatgcaaatccaatggttgcacac

SEQ ID NO: 247267 - DNA, 24 bp, Artificial sequence
  SiRNA target sequence
atgcaaatccaatggttgcacacc

SEQ ID NO: 247268 - DNA, 24 bp, Artificial sequence
  SiRNA target sequence
tgcaaatccaatggttgcacacca

SEQ ID NO: 247269 - DNA, 24 bp, Artificial sequence
  SiRNA target sequence
gcaaatccaatggttgcacaccaa

SEQ ID NO: 247270 - DNA, 24 bp, Artificial sequence
  SiRNA target sequence
caaatccaatggttgcacaccaat

SEQ ID NO: 247271 - DNA, 24 bp, Artificial sequence
  SiRNA target sequence
aaatccaatggttgcacaccaatt

SEQ ID NO: 247272 - DNA, 24 bp, Artificial sequence
  SiRNA target sequence
aatccaatggttgcacaccaattt

SEQ ID NO: 247273 - DNA, 24 bp, Artificial sequence
  SiRNA target sequence
atccaatggttgcacaccaatttt

SEQ ID NO: 247274 - DNA, 24 bp, Artificial sequence
  SiRNA target sequence
tccaatggttgcacaccaattttc

SEQ ID NO: 247275 - DNA, 24 bp, Artificial sequence
  SiRNA target sequence
ccaatggttgcacaccaattttca

SEQ ID NO: 247276 - DNA, 24 bp, Artificial sequence
  SiRNA target sequence
caatggttgcacaccaattttcaa

SEQ ID NO: 247277 - DNA, 24 bp, Artificial sequence
  SiRNA target sequence
aatggttgcacaccaattttcaag

SEQ ID NO: 247278 - DNA, 24 bp, Artificial sequence
  SiRNA target sequence
atggttgcacaccaattttcaaga

SEQ ID NO: 247279 - DNA, 24 bp, Artificial sequence
  SiRNA target sequence
tggttgcacaccaattttcaagat

SEQ ID NO: 247280 - DNA, 24 bp, Artificial sequence
  SiRNA target sequence
ggttgcacaccaattttcaagatt

SEQ ID NO: 247281 - DNA, 24 bp, Artificial sequence
  SiRNA target sequence
gttgcacaccaattttcaagattt

SEQ ID NO: 247282 - DNA, 24 bp, Artificial sequence
  SiRNA target sequence
ttgcacaccaattttcaagattta

SEQ ID NO: 247283 - DNA, 24 bp, Artificial sequence
  SiRNA target sequence
tgcacaccaattttcaagatttat

SEQ ID NO: 247284 - DNA, 24 bp, Artificial sequence
  SiRNA target sequence
gcacaccaattttcaagatttatt

SEQ ID NO: 247285 - DNA, 24 bp, Artificial sequence
  SiRNA target sequence
cacaccaattttcaagatttattc

SEQ ID NO: 247286 - DNA, 24 bp, Artificial sequence
  SiRNA target sequence
acaccaattttcaagatttattct

SEQ ID NO: 247287 - DNA, 24 bp, Artificial sequence
  SiRNA target sequence
caccaattttcaagatttattctt

SEQ ID NO: 247288 - DNA, 24 bp, Artificial sequence
  SiRNA target sequence
accaattttcaagatttattctta

SEQ ID NO: 247289 - DNA, 24 bp, Artificial sequence
  SiRNA target sequence
ccaattttcaagatttattcttaa

SEQ ID NO: 247290 - DNA, 24 bp, Artificial sequence
  SiRNA target sequence
caattttcaagatttattcttaag

SEQ ID NO: 247291 - DNA, 24 bp, Artificial sequence
  SiRNA target sequence
aattttcaagatttattcttaaga

SEQ ID NO: 247292 - DNA, 24 bp, Artificial sequence
  SiRNA target sequence
attttcaagatttattcttaagac

SEQ ID NO: 247293 - DNA, 24 bp, Artificial sequence
  SiRNA target sequence
ttttcaagatttattcttaagacc

SEQ ID NO: 247294 - DNA, 24 bp, Artificial sequence
  SiRNA target sequence
tttcaagatttattcttaagaccg

SEQ ID NO: 247295 - DNA, 24 bp, Artificial sequence
  SiRNA target sequence
ttcaagatttattcttaagaccga

SEQ ID NO: 247296 - DNA, 24 bp, Artificial sequence
  SiRNA target sequence
tcaagatttattcttaagaccgat

SEQ ID NO: 247297 - DNA, 24 bp, Artificial sequence
  SiRNA target sequence
caagatttattcttaagaccgatg

SEQ ID NO: 247298 - DNA, 24 bp, Artificial sequence
  SiRNA target sequence
aagatttattcttaagaccgatgg

SEQ ID NO: 247299 - DNA, 24 bp, Artificial sequence
  SiRNA target sequence
agatttattcttaagaccgatgga

SEQ ID NO: 247300 - DNA, 24 bp, Artificial sequence
  SiRNA target sequence
gatttattcttaagaccgatggag

SEQ ID NO: 247301 - DNA, 24 bp, Artificial sequence
  SiRNA target sequence
atttattcttaagaccgatggagc

SEQ ID NO: 247302 - DNA, 24 bp, Artificial sequence
  SiRNA target sequence
tttattcttaagaccgatggagct

SEQ ID NO: 247303 - DNA, 24 bp, Artificial sequence
  SiRNA target sequence
ttattcttaagaccgatggagctg

SEQ ID NO: 247304 - DNA, 24 bp, Artificial sequence
  SiRNA target sequence
tattcttaagaccgatggagctgt

SEQ ID NO: 247305 - DNA, 24 bp, Artificial sequence
  SiRNA target sequence
attcttaagaccgatggagctgtg

SEQ ID NO: 247306 - DNA, 24 bp, Artificial sequence
  SiRNA target sequence
ttcttaagaccgatggagctgtgc

SEQ ID NO: 247307 - DNA, 24 bp, Artificial sequence
  SiRNA target sequence
tcttaagaccgatggagctgtgcg

SEQ ID NO: 247308 - DNA, 24 bp, Artificial sequence
  SiRNA target sequence
cttaagaccgatggagctgtgcgc

SEQ ID NO: 247309 - DNA, 24 bp, Artificial sequence
  SiRNA target sequence
ttaagaccgatggagctgtgcgca

SEQ ID NO: 247310 - DNA, 24 bp, Artificial sequence
  SiRNA target sequence
taagaccgatggagctgtgcgcaa

SEQ ID NO: 247311 - DNA, 24 bp, Artificial sequence
  SiRNA target sequence
aagaccgatggagctgtgcgcaaa

SEQ ID NO: 247312 - DNA, 24 bp, Artificial sequence
  SiRNA target sequence
agaccgatggagctgtgcgcaaat

SEQ ID NO: 247313 - DNA, 24 bp, Artificial sequence
  SiRNA target sequence
gaccgatggagctgtgcgcaaatt

SEQ ID NO: 247314 - DNA, 24 bp, Artificial sequence
  SiRNA target sequence
accgatggagctgtgcgcaaattg

SEQ ID NO: 247315 - DNA, 24 bp, Artificial sequence
  SiRNA target sequence
ccgatggagctgtgcgcaaattgt

SEQ ID NO: 247316 - DNA, 24 bp, Artificial sequence
  SiRNA target sequence
cgatggagctgtgcgcaaattgta

SEQ ID NO: 247317 - DNA, 24 bp, Artificial sequence
  SiRNA target sequence
gatggagctgtgcgcaaattgtaa

SEQ ID NO: 247318 - DNA, 24 bp, Artificial sequence
  SiRNA target sequence
atggagctgtgcgcaaattgtaaa

SEQ ID NO: 247319 - DNA, 24 bp, Artificial sequence
  SiRNA target sequence
tggagctgtgcgcaaattgtaaaa

SEQ ID NO: 247320 - DNA, 24 bp, Artificial sequence
  SiRNA target sequence
ggagctgtgcgcaaattgtaaaaa

SEQ ID NO: 247321 - DNA, 24 bp, Artificial sequence
  SiRNA target sequence
gagctgtgcgcaaattgtaaaaag

SEQ ID NO: 247322 - DNA, 24 bp, Artificial sequence
  SiRNA target sequence
agctgtgcgcaaattgtaaaaaga

SEQ ID NO: 247323 - DNA, 24 bp, Artificial sequence
  SiRNA target sequence
gctgtgcgcaaattgtaaaaagaa

SEQ ID NO: 247324 - DNA, 24 bp, Artificial sequence
  SiRNA target sequence
ctgtgcgcaaattgtaaaaagaaa

SEQ ID NO: 247325 - DNA, 24 bp, Artificial sequence
  SiRNA target sequence
tgtgcgcaaattgtaaaaagaaag

SEQ ID NO: 247326 - DNA, 24 bp, Artificial sequence
  SiRNA target sequence
gtgcgcaaattgtaaaaagaaagt

SEQ ID NO: 247327 - DNA, 24 bp, Artificial sequence
  SiRNA target sequence
tgcgcaaattgtaaaaagaaagtc

SEQ ID NO: 247328 - DNA, 24 bp, Artificial sequence
  SiRNA target sequence
gcgcaaattgtaaaaagaaagtcc

SEQ ID NO: 247329 - DNA, 24 bp, Artificial sequence
  SiRNA target sequence
cgcaaattgtaaaaagaaagtcct

SEQ ID NO: 247330 - DNA, 24 bp, Artificial sequence
  SiRNA target sequence
gcaaattgtaaaaagaaagtcctg

SEQ ID NO: 247331 - DNA, 24 bp, Artificial sequence
  SiRNA target sequence
caaattgtaaaaagaaagtcctga

SEQ ID NO: 247332 - DNA, 24 bp, Artificial sequence
  SiRNA target sequence
aaattgtaaaaagaaagtcctgaa

SEQ ID NO: 247333 - DNA, 24 bp, Artificial sequence
  SiRNA target sequence
aattgtaaaaagaaagtcctgaaa

SEQ ID NO: 247334 - DNA, 24 bp, Artificial sequence
  SiRNA target sequence
attgtaaaaagaaagtcctgaaat

SEQ ID NO: 247335 - DNA, 24 bp, Artificial sequence
  SiRNA target sequence
ttgtaaaaagaaagtcctgaaatt

SEQ ID NO: 247336 - DNA, 24 bp, Artificial sequence
  SiRNA target sequence
tgtaaaaagaaagtcctgaaatta

SEQ ID NO: 247337 - DNA, 24 bp, Artificial sequence
  SiRNA target sequence
gtaaaaagaaagtcctgaaattag

SEQ ID NO: 247338 - DNA, 24 bp, Artificial sequence
  SiRNA target sequence
taaaaagaaagtcctgaaattaga

SEQ ID NO: 247339 - DNA, 24 bp, Artificial sequence
  SiRNA target sequence
aaaaagaaagtcctgaaattagag

SEQ ID NO: 247340 - DNA, 24 bp, Artificial sequence
  SiRNA target sequence
aaaagaaagtcctgaaattagagc

SEQ ID NO: 247341 - DNA, 24 bp, Artificial sequence
  SiRNA target sequence
aaagaaagtcctgaaattagagcg

SEQ ID NO: 247342 - DNA, 24 bp, Artificial sequence
  SiRNA target sequence
aagaaagtcctgaaattagagcgg

SEQ ID NO: 247343 - DNA, 24 bp, Artificial sequence
  SiRNA target sequence
agaaagtcctgaaattagagcggt

SEQ ID NO: 247344 - DNA, 24 bp, Artificial sequence
  SiRNA target sequence
gaaagtcctgaaattagagcggta

SEQ ID NO: 247345 - DNA, 24 bp, Artificial sequence
  SiRNA target sequence
aaagtcctgaaattagagcggtaa

SEQ ID NO: 247346 - DNA, 24 bp, Artificial sequence
  SiRNA target sequence
aagtcctgaaattagagcggtaaa

SEQ ID NO: 247347 - DNA, 24 bp, Artificial sequence
  SiRNA target sequence
agtcctgaaattagagcggtaaaa

SEQ ID NO: 247348 - DNA, 24 bp, Artificial sequence
  SiRNA target sequence
gtcctgaaattagagcggtaaaaa

SEQ ID NO: 247349 - DNA, 24 bp, Artificial sequence
  SiRNA target sequence
tcctgaaattagagcggtaaaaaa

SEQ ID NO: 247350 - DNA, 24 bp, Artificial sequence
  SiRNA target sequence
cctgaaattagagcggtaaaaaat

SEQ ID NO: 247351 - DNA, 24 bp, Artificial sequence
  SiRNA target sequence
ctgaaattagagcggtaaaaaata

SEQ ID NO: 247352 - DNA, 24 bp, Artificial sequence
  SiRNA target sequence
tgaaattagagcggtaaaaaatat

SEQ ID NO: 247353 - DNA, 24 bp, Artificial sequence
  SiRNA target sequence
gaaattagagcggtaaaaaatata

SEQ ID NO: 247354 - DNA, 24 bp, Artificial sequence
  SiRNA target sequence
aaattagagcggtaaaaaatatag

SEQ ID NO: 247355 - DNA, 24 bp, Artificial sequence
  SiRNA target sequence
aattagagcggtaaaaaatatagc

SEQ ID NO: 247356 - DNA, 24 bp, Artificial sequence
  SiRNA target sequence
attagagcggtaaaaaatatagca

SEQ ID NO: 247357 - DNA, 24 bp, Artificial sequence
  SiRNA target sequence
ttagagcggtaaaaaatatagcag

SEQ ID NO: 247358 - DNA, 24 bp, Artificial sequence
  SiRNA target sequence
tagagcggtaaaaaatatagcagc

SEQ ID NO: 247359 - DNA, 24 bp, Artificial sequence
  SiRNA target sequence
agagcggtaaaaaatatagcagca

SEQ ID NO: 247360 - DNA, 24 bp, Artificial sequence
  SiRNA target sequence
gagcggtaaaaaatatagcagcaa

SEQ ID NO: 247361 - DNA, 24 bp, Artificial sequence
  SiRNA target sequence
agcggtaaaaaatatagcagcaat

SEQ ID NO: 247362 - DNA, 24 bp, Artificial sequence
  SiRNA target sequence
gcggtaaaaaatatagcagcaata

SEQ ID NO: 247363 - DNA, 24 bp, Artificial sequence
  SiRNA target sequence
cggtaaaaaatatagcagcaatag

SEQ ID NO: 247364 - DNA, 24 bp, Artificial sequence
  SiRNA target sequence
ggtaaaaaatatagcagcaatagg

SEQ ID NO: 247365 - DNA, 24 bp, Artificial sequence
  SiRNA target sequence
gtaaaaaatatagcagcaataggg

SEQ ID NO: 247366 - DNA, 24 bp, Artificial sequence
  SiRNA target sequence
taaaaaatatagcagcaatagggg

SEQ ID NO: 247367 - DNA, 24 bp, Artificial sequence
  SiRNA target sequence
aaaaaatatagcagcaatagggga

SEQ ID NO: 247368 - DNA, 24 bp, Artificial sequence
  SiRNA target sequence
aaaaatatagcagcaataggggag

SEQ ID NO: 247369 - DNA, 24 bp, Artificial sequence
  SiRNA target sequence
aaaatatagcagcaataggggagg

SEQ ID NO: 247370 - DNA, 24 bp, Artificial sequence
  SiRNA target sequence
aaatatagcagcaataggggaggc

SEQ ID NO: 247371 - DNA, 24 bp, Artificial sequence
  SiRNA target sequence
aatatagcagcaataggggaggca

SEQ ID NO: 247372 - DNA, 24 bp, Artificial sequence
  SiRNA target sequence
atatagcagcaataggggaggcaa

SEQ ID NO: 247373 - DNA, 24 bp, Artificial sequence
  SiRNA target sequence
tatagcagcaataggggaggcaat

SEQ ID NO: 247374 - DNA, 24 bp, Artificial sequence
  SiRNA target sequence
atagcagcaataggggaggcaata

SEQ ID NO: 247375 - DNA, 24 bp, Artificial sequence
  SiRNA target sequence
tagcagcaataggggaggcaatag

SEQ ID NO: 247376 - DNA, 24 bp, Artificial sequence
  SiRNA target sequence
agcagcaataggggaggcaataga

SEQ ID NO: 247377 - DNA, 24 bp, Artificial sequence
  SiRNA target sequence
gcagcaataggggaggcaatagat

SEQ ID NO: 247378 - DNA, 24 bp, Artificial sequence
  SiRNA target sequence
cagcaataggggaggcaatagata

SEQ ID NO: 247379 - DNA, 24 bp, Artificial sequence
  SiRNA target sequence
agcaataggggaggcaatagatag

SEQ ID NO: 247380 - DNA, 24 bp, Artificial sequence
  SiRNA target sequence
gcaataggggaggcaatagataga

SEQ ID NO: 247381 - DNA, 24 bp, Artificial sequence
  SiRNA target sequence
caataggggaggcaatagatagat

SEQ ID NO: 247382 - DNA, 24 bp, Artificial sequence
  SiRNA target sequence
aataggggaggcaatagatagata

SEQ ID NO: 247383 - DNA, 24 bp, Artificial sequence
  SiRNA target sequence
ataggggaggcaatagatagataa

SEQ ID NO: 247384 - DNA, 24 bp, Artificial sequence
  SiRNA target sequence
taggggaggcaatagatagataaa

SEQ ID NO: 247385 - DNA, 24 bp, Artificial sequence
  SiRNA target sequence
aggggaggcaatagatagataaaa

SEQ ID NO: 247386 - DNA, 24 bp, Artificial sequence
  SiRNA target sequence
ggggaggcaatagatagataaaag

SEQ ID NO: 247387 - DNA, 24 bp, Artificial sequence
  SiRNA target sequence
gggaggcaatagatagataaaaga

SEQ ID NO: 247388 - DNA, 24 bp, Artificial sequence
  SiRNA target sequence
ggaggcaatagatagataaaagat

SEQ ID NO: 247389 - DNA, 24 bp, Artificial sequence
  SiRNA target sequence
gaggcaatagatagataaaagatc

SEQ ID NO: 247390 - DNA, 24 bp, Artificial sequence
  SiRNA target sequence
aggcaatagatagataaaagatcc

SEQ ID NO: 247391 - DNA, 24 bp, Artificial sequence
  SiRNA target sequence
ggcaatagatagataaaagatcct

SEQ ID NO: 247392 - DNA, 24 bp, Artificial sequence
  SiRNA target sequence
gcaatagatagataaaagatcctt

SEQ ID NO: 247393 - DNA, 24 bp, Artificial sequence
  SiRNA target sequence
caatagatagataaaagatccttg

SEQ ID NO: 247394 - DNA, 24 bp, Artificial sequence
  SiRNA target sequence
aatagatagataaaagatccttga

SEQ ID NO: 247395 - DNA, 24 bp, Artificial sequence
  SiRNA target sequence
atagatagataaaagatccttgat

SEQ ID NO: 247396 - DNA, 24 bp, Artificial sequence
  SiRNA target sequence
tagatagataaaagatccttgatg

SEQ ID NO: 247397 - DNA, 24 bp, Artificial sequence
  SiRNA target sequence
agatagataaaagatccttgatgc

SEQ ID NO: 247398 - DNA, 24 bp, Artificial sequence
  SiRNA target sequence
gatagataaaagatccttgatgca

SEQ ID NO: 247399 - DNA, 24 bp, Artificial sequence
  SiRNA target sequence
atagataaaagatccttgatgcaa

SEQ ID NO: 247400 - DNA, 24 bp, Artificial sequence
  SiRNA target sequence
tagataaaagatccttgatgcaat

SEQ ID NO: 247401 - DNA, 24 bp, Artificial sequence
  SiRNA target sequence
agataaaagatccttgatgcaatg

SEQ ID NO: 247402 - DNA, 24 bp, Artificial sequence
  SiRNA target sequence
gataaaagatccttgatgcaatgc

SEQ ID NO: 247403 - DNA, 24 bp, Artificial sequence
  SiRNA target sequence
ataaaagatccttgatgcaatgcg

SEQ ID NO: 247404 - DNA, 24 bp, Artificial sequence
  SiRNA target sequence
taaaagatccttgatgcaatgcga

SEQ ID NO: 247405 - DNA, 24 bp, Artificial sequence
  SiRNA target sequence
aaaagatccttgatgcaatgcgat

SEQ ID NO: 247406 - DNA, 24 bp, Artificial sequence
  SiRNA target sequence
aaagatccttgatgcaatgcgatt

SEQ ID NO: 247407 - DNA, 24 bp, Artificial sequence
  SiRNA target sequence
aagatccttgatgcaatgcgattt

SEQ ID NO: 247408 - DNA, 24 bp, Artificial sequence
  SiRNA target sequence
agatccttgatgcaatgcgatttc

SEQ ID NO: 247409 - DNA, 24 bp, Artificial sequence
  SiRNA target sequence
gatccttgatgcaatgcgatttcc

SEQ ID NO: 247410 - DNA, 24 bp, Artificial sequence
  SiRNA target sequence
atccttgatgcaatgcgatttcca

SEQ ID NO: 247411 - DNA, 24 bp, Artificial sequence
  SiRNA target sequence
tccttgatgcaatgcgatttccac

SEQ ID NO: 247412 - DNA, 24 bp, Artificial sequence
  SiRNA target sequence
ccttgatgcaatgcgatttccacg

SEQ ID NO: 247413 - DNA, 24 bp, Artificial sequence
  SiRNA target sequence
cttgatgcaatgcgatttccacgg

SEQ ID NO: 247414 - DNA, 24 bp, Artificial sequence
  SiRNA target sequence
ttgatgcaatgcgatttccacgga

SEQ ID NO: 247415 - DNA, 24 bp, Artificial sequence
  SiRNA target sequence
tgatgcaatgcgatttccacggat

SEQ ID NO: 247416 - DNA, 24 bp, Artificial sequence
  SiRNA target sequence
gatgcaatgcgatttccacggatt

SEQ ID NO: 247417 - DNA, 24 bp, Artificial sequence
  SiRNA target sequence
atgcaatgcgatttccacggatta

SEQ ID NO: 247418 - DNA, 24 bp, Artificial sequence
  SiRNA target sequence
tgcaatgcgatttccacggattac

SEQ ID NO: 247419 - DNA, 24 bp, Artificial sequence
  SiRNA target sequence
gcaatgcgatttccacggattaca

SEQ ID NO: 247420 - DNA, 24 bp, Artificial sequence
  SiRNA target sequence
caatgcgatttccacggattacaa

SEQ ID NO: 247421 - DNA, 24 bp, Artificial sequence
  SiRNA target sequence
aatgcgatttccacggattacaaa

SEQ ID NO: 247422 - DNA, 24 bp, Artificial sequence
  SiRNA target sequence
atgcgatttccacggattacaaag

SEQ ID NO: 247423 - DNA, 24 bp, Artificial sequence
  SiRNA target sequence
tgcgatttccacggattacaaagt

SEQ ID NO: 247424 - DNA, 24 bp, Artificial sequence
  SiRNA target sequence
gcgatttccacggattacaaagtt

SEQ ID NO: 247425 - DNA, 24 bp, Artificial sequence
  SiRNA target sequence
cgatttccacggattacaaagtta

SEQ ID NO: 247426 - DNA, 24 bp, Artificial sequence
  SiRNA target sequence
gatttccacggattacaaagttat

SEQ ID NO: 247427 - DNA, 24 bp, Artificial sequence
  SiRNA target sequence
atttccacggattacaaagttata

SEQ ID NO: 247428 - DNA, 24 bp, Artificial sequence
  SiRNA target sequence
tttccacggattacaaagttataa

SEQ ID NO: 247429 - DNA, 24 bp, Artificial sequence
  SiRNA target sequence
ttccacggattacaaagttataaa

SEQ ID NO: 247430 - DNA, 24 bp, Artificial sequence
  SiRNA target sequence
tccacggattacaaagttataaaa

SEQ ID NO: 247431 - DNA, 24 bp, Artificial sequence
  SiRNA target sequence
ccacggattacaaagttataaaat

SEQ ID NO: 247432 - DNA, 24 bp, Artificial sequence
  SiRNA target sequence
cacggattacaaagttataaaata

SEQ ID NO: 247433 - DNA, 24 bp, Artificial sequence
  SiRNA target sequence
acggattacaaagttataaaataa

SEQ ID NO: 247434 - DNA, 24 bp, Artificial sequence
  SiRNA target sequence
cggattacaaagttataaaataat

SEQ ID NO: 247435 - DNA, 24 bp, Artificial sequence
  SiRNA target sequence
ggattacaaagttataaaataatg

SEQ ID NO: 247436 - DNA, 24 bp, Artificial sequence
  SiRNA target sequence
gattacaaagttataaaataatga

SEQ ID NO: 247437 - DNA, 24 bp, Artificial sequence
  SiRNA target sequence
attacaaagttataaaataatgat

SEQ ID NO: 247438 - DNA, 24 bp, Artificial sequence
  SiRNA target sequence
ttacaaagttataaaataatgata

SEQ ID NO: 247439 - DNA, 24 bp, Artificial sequence
  SiRNA target sequence
tacaaagttataaaataatgatac

SEQ ID NO: 247440 - DNA, 24 bp, Artificial sequence
  SiRNA target sequence
acaaagttataaaataatgataca

SEQ ID NO: 247441 - DNA, 24 bp, Artificial sequence
  SiRNA target sequence
caaagttataaaataatgatacag

SEQ ID NO: 247442 - DNA, 24 bp, Artificial sequence
  SiRNA target sequence
aaagttataaaataatgatacagc

SEQ ID NO: 247443 - DNA, 24 bp, Artificial sequence
  SiRNA target sequence
aagttataaaataatgatacagca

SEQ ID NO: 247444 - DNA, 24 bp, Artificial sequence
  SiRNA target sequence
agttataaaataatgatacagcac

SEQ ID NO: 247445 - DNA, 24 bp, Artificial sequence
  SiRNA target sequence
gttataaaataatgatacagcact

SEQ ID NO: 247446 - DNA, 24 bp, Artificial sequence
  SiRNA target sequence
ttataaaataatgatacagcacta

SEQ ID NO: 247447 - DNA, 24 bp, Artificial sequence
  SiRNA target sequence
tataaaataatgatacagcactaa

SEQ ID NO: 247448 - DNA, 24 bp, Artificial sequence
  SiRNA target sequence
ataaaataatgatacagcactaat

SEQ ID NO: 247449 - DNA, 24 bp, Artificial sequence
  SiRNA target sequence
taaaataatgatacagcactaatc

SEQ ID NO: 247450 - DNA, 24 bp, Artificial sequence
  SiRNA target sequence
aaaataatgatacagcactaatcg

SEQ ID NO: 247451 - DNA, 24 bp, Artificial sequence
  SiRNA target sequence
aaataatgatacagcactaatcgt

SEQ ID NO: 247452 - DNA, 24 bp, Artificial sequence
  SiRNA target sequence
aataatgatacagcactaatcgtt

SEQ ID NO: 247453 - DNA, 24 bp, Artificial sequence
  SiRNA target sequence
ataatgatacagcactaatcgtta

SEQ ID NO: 247454 - DNA, 24 bp, Artificial sequence
  SiRNA target sequence
taatgatacagcactaatcgttaa

SEQ ID NO: 247455 - DNA, 24 bp, Artificial sequence
  SiRNA target sequence
aatgatacagcactaatcgttaag

SEQ ID NO: 247456 - DNA, 24 bp, Artificial sequence
  SiRNA target sequence
atgatacagcactaatcgttaagg

SEQ ID NO: 247457 - DNA, 24 bp, Artificial sequence
  SiRNA target sequence
tgatacagcactaatcgttaagga

SEQ ID NO: 247458 - DNA, 24 bp, Artificial sequence
  SiRNA target sequence
gatacagcactaatcgttaaggaa

SEQ ID NO: 247459 - DNA, 24 bp, Artificial sequence
  SiRNA target sequence
atacagcactaatcgttaaggaag

SEQ ID NO: 247460 - DNA, 24 bp, Artificial sequence
  SiRNA target sequence
tacagcactaatcgttaaggaagt

SEQ ID NO: 247461 - DNA, 24 bp, Artificial sequence
  SiRNA target sequence
acagcactaatcgttaaggaagtt

SEQ ID NO: 247462 - DNA, 24 bp, Artificial sequence
  SiRNA target sequence
cagcactaatcgttaaggaagttg

SEQ ID NO: 247463 - DNA, 24 bp, Artificial sequence
  SiRNA target sequence
agcactaatcgttaaggaagttgt

SEQ ID NO: 247464 - DNA, 24 bp, Artificial sequence
  SiRNA target sequence
gcactaatcgttaaggaagttgtt

SEQ ID NO: 247465 - DNA, 24 bp, Artificial sequence
  SiRNA target sequence
cactaatcgttaaggaagttgtta

SEQ ID NO: 247466 - DNA, 24 bp, Artificial sequence
  SiRNA target sequence
actaatcgttaaggaagttgttac

SEQ ID NO: 247467 - DNA, 24 bp, Artificial sequence
  SiRNA target sequence
ctaatcgttaaggaagttgttact

SEQ ID NO: 247468 - DNA, 24 bp, Artificial sequence
  SiRNA target sequence
taatcgttaaggaagttgttacta

SEQ ID NO: 247469 - DNA, 24 bp, Artificial sequence
  SiRNA target sequence
aatcgttaaggaagttgttactaa

SEQ ID NO: 247470 - DNA, 24 bp, Artificial sequence
  SiRNA target sequence
atcgttaaggaagttgttactaaa

SEQ ID NO: 247471 - DNA, 24 bp, Artificial sequence
  SiRNA target sequence
tcgttaaggaagttgttactaaat

SEQ ID NO: 247472 - DNA, 24 bp, Artificial sequence
  SiRNA target sequence
cgttaaggaagttgttactaaata

SEQ ID NO: 247473 - DNA, 24 bp, Artificial sequence
  SiRNA target sequence
gttaaggaagttgttactaaatat

SEQ ID NO: 247474 - DNA, 24 bp, Artificial sequence
  SiRNA target sequence
ttaaggaagttgttactaaatatt

SEQ ID NO: 247475 - DNA, 24 bp, Artificial sequence
  SiRNA target sequence
taaggaagttgttactaaatattt

SEQ ID NO: 247476 - DNA, 24 bp, Artificial sequence
  SiRNA target sequence
aaggaagttgttactaaatatttt

SEQ ID NO: 247477 - DNA, 24 bp, Artificial sequence
  SiRNA target sequence
aggaagttgttactaaatattttt

SEQ ID NO: 247478 - DNA, 24 bp, Artificial sequence
  SiRNA target sequence
ggaagttgttactaaatatttttg

SEQ ID NO: 247479 - DNA, 24 bp, Artificial sequence
  SiRNA target sequence
gaagttgttactaaatatttttga

SEQ ID NO: 247480 - DNA, 24 bp, Artificial sequence
  SiRNA target sequence
aagttgttactaaatatttttgag

SEQ ID NO: 247481 - DNA, 24 bp, Artificial sequence
  SiRNA target sequence
agttgttactaaatatttttgaga

SEQ ID NO: 247482 - DNA, 24 bp, Artificial sequence
  SiRNA target sequence
gttgttactaaatatttttgagaa

SEQ ID NO: 247483 - DNA, 24 bp, Artificial sequence
  SiRNA target sequence
ttgttactaaatatttttgagaat

SEQ ID NO: 247484 - DNA, 24 bp, Artificial sequence
  SiRNA target sequence
tgttactaaatatttttgagaata

SEQ ID NO: 247485 - DNA, 24 bp, Artificial sequence
  SiRNA target sequence
gttactaaatatttttgagaataa

SEQ ID NO: 247486 - DNA, 24 bp, Artificial sequence
  SiRNA target sequence
ttactaaatatttttgagaataat

SEQ ID NO: 247487 - DNA, 24 bp, Artificial sequence
  SiRNA target sequence
tactaaatatttttgagaataatc

SEQ ID NO: 247488 - DNA, 24 bp, Artificial sequence
  SiRNA target sequence
actaaatatttttgagaataatct

SEQ ID NO: 247489 - DNA, 24 bp, Artificial sequence
  SiRNA target sequence
ctaaatatttttgagaataatctt

SEQ ID NO: 247490 - DNA, 24 bp, Artificial sequence
  SiRNA target sequence
taaatatttttgagaataatcttt

SEQ ID NO: 247491 - DNA, 24 bp, Artificial sequence
  SiRNA target sequence
aaatatttttgagaataatctttc

SEQ ID NO: 247492 - DNA, 24 bp, Artificial sequence
  SiRNA target sequence
aatatttttgagaataatctttcg

SEQ ID NO: 247493 - DNA, 24 bp, Artificial sequence
  SiRNA target sequence
atatttttgagaataatctttcgg

SEQ ID NO: 247494 - DNA, 24 bp, Artificial sequence
  SiRNA target sequence
tatttttgagaataatctttcgga

SEQ ID NO: 247495 - DNA, 24 bp, Artificial sequence
  SiRNA target sequence
atttttgagaataatctttcggag

SEQ ID NO: 247496 - DNA, 24 bp, Artificial sequence
  SiRNA target sequence
tttttgagaataatctttcggagg

SEQ ID NO: 247497 - DNA, 24 bp, Artificial sequence
  SiRNA target sequence
ttttgagaataatctttcggaggc

SEQ ID NO: 247498 - DNA, 24 bp, Artificial sequence
  SiRNA target sequence
tttgagaataatctttcggaggca

SEQ ID NO: 247499 - DNA, 24 bp, Artificial sequence
  SiRNA target sequence
ttgagaataatctttcggaggcat

SEQ ID NO: 247500 - DNA, 24 bp, Artificial sequence
  SiRNA target sequence
tgagaataatctttcggaggcata

SEQ ID NO: 247501 - DNA, 24 bp, Artificial sequence
  SiRNA target sequence
gagaataatctttcggaggcatat

SEQ ID NO: 247502 - DNA, 24 bp, Artificial sequence
  SiRNA target sequence
agaataatctttcggaggcatatt

SEQ ID NO: 247503 - DNA, 24 bp, Artificial sequence
  SiRNA target sequence
gaataatctttcggaggcatatta

SEQ ID NO: 247504 - DNA, 24 bp, Artificial sequence
  SiRNA target sequence
aataatctttcggaggcatattat

SEQ ID NO: 247505 - DNA, 24 bp, Artificial sequence
  SiRNA target sequence
ataatctttcggaggcatattatt

SEQ ID NO: 247506 - DNA, 24 bp, Artificial sequence
  SiRNA target sequence
taatctttcggaggcatattatta

SEQ ID NO: 247507 - DNA, 24 bp, Artificial sequence
  SiRNA target sequence
aatctttcggaggcatattattaa

SEQ ID NO: 247508 - DNA, 24 bp, Artificial sequence
  SiRNA target sequence
atctttcggaggcatattattaat

SEQ ID NO: 247509 - DNA, 24 bp, Artificial sequence
  SiRNA target sequence
tctttcggaggcatattattaatt

SEQ ID NO: 247510 - DNA, 24 bp, Artificial sequence
  SiRNA target sequence
ctttcggaggcatattattaattc

SEQ ID NO: 247511 - DNA, 24 bp, Artificial sequence
  SiRNA target sequence
tttcggaggcatattattaattct

SEQ ID NO: 247512 - DNA, 24 bp, Artificial sequence
  SiRNA target sequence
ttcggaggcatattattaattctg

SEQ ID NO: 247513 - DNA, 24 bp, Artificial sequence
  SiRNA target sequence
tcggaggcatattattaattctgc

SEQ ID NO: 247514 - DNA, 24 bp, Artificial sequence
  SiRNA target sequence
cggaggcatattattaattctgct

SEQ ID NO: 247515 - DNA, 24 bp, Artificial sequence
  SiRNA target sequence
ggaggcatattattaattctgctt

SEQ ID NO: 247516 - DNA, 24 bp, Artificial sequence
  SiRNA target sequence
gaggcatattattaattctgcttc

SEQ ID NO: 247517 - DNA, 24 bp, Artificial sequence
  SiRNA target sequence
aggcatattattaattctgcttcc

SEQ ID NO: 247518 - DNA, 24 bp, Artificial sequence
  SiRNA target sequence
ggcatattattaattctgcttccc

SEQ ID NO: 247519 - DNA, 24 bp, Artificial sequence
  SiRNA target sequence
gcatattattaattctgcttcccg

SEQ ID NO: 247520 - DNA, 24 bp, Artificial sequence
  SiRNA target sequence
catattattaattctgcttcccgt

SEQ ID NO: 247521 - DNA, 24 bp, Artificial sequence
  SiRNA target sequence
atattattaattctgcttcccgta

SEQ ID NO: 247522 - DNA, 24 bp, Artificial sequence
  SiRNA target sequence
tattattaattctgcttcccgtag

SEQ ID NO: 247523 - DNA, 24 bp, Artificial sequence
  SiRNA target sequence
attattaattctgcttcccgtaga

SEQ ID NO: 247524 - DNA, 24 bp, Artificial sequence
  SiRNA target sequence
ttattaattctgcttcccgtagat

SEQ ID NO: 247525 - DNA, 24 bp, Artificial sequence
  SiRNA target sequence
tattaattctgcttcccgtagata

SEQ ID NO: 247526 - DNA, 24 bp, Artificial sequence
  SiRNA target sequence
attaattctgcttcccgtagataa

SEQ ID NO: 247527 - DNA, 24 bp, Artificial sequence
  SiRNA target sequence
ttaattctgcttcccgtagataaa

SEQ ID NO: 247528 - DNA, 24 bp, Artificial sequence
  SiRNA target sequence
taattctgcttcccgtagataaag

SEQ ID NO: 247529 - DNA, 24 bp, Artificial sequence
  SiRNA target sequence
aattctgcttcccgtagataaaga

SEQ ID NO: 247530 - DNA, 24 bp, Artificial sequence
  SiRNA target sequence
attctgcttcccgtagataaagaa

SEQ ID NO: 247531 - DNA, 24 bp, Artificial sequence
  SiRNA target sequence
ttctgcttcccgtagataaagaat

SEQ ID NO: 247532 - DNA, 24 bp, Artificial sequence
  SiRNA target sequence
tctgcttcccgtagataaagaatt

SEQ ID NO: 247533 - DNA, 24 bp, Artificial sequence
  SiRNA target sequence
ctgcttcccgtagataaagaattt

SEQ ID NO: 247534 - DNA, 24 bp, Artificial sequence
  SiRNA target sequence
tgcttcccgtagataaagaatttt

SEQ ID NO: 247535 - DNA, 24 bp, Artificial sequence
  SiRNA target sequence
gcttcccgtagataaagaattttt

SEQ ID NO: 247536 - DNA, 24 bp, Artificial sequence
  SiRNA target sequence
cttcccgtagataaagaatttttt

SEQ ID NO: 247537 - DNA, 24 bp, Artificial sequence
  SiRNA target sequence
ttcccgtagataaagaatttttta

SEQ ID NO: 247538 - DNA, 24 bp, Artificial sequence
  SiRNA target sequence
tcccgtagataaagaattttttaa

SEQ ID NO: 247539 - DNA, 24 bp, Artificial sequence
  SiRNA target sequence
cccgtagataaagaattttttaag

SEQ ID NO: 247540 - DNA, 24 bp, Artificial sequence
  SiRNA target sequence
ccgtagataaagaattttttaagg

SEQ ID NO: 247541 - DNA, 24 bp, Artificial sequence
  SiRNA target sequence
cgtagataaagaattttttaagga

SEQ ID NO: 247542 - DNA, 24 bp, Artificial sequence
  SiRNA target sequence
gtagataaagaattttttaaggac

SEQ ID NO: 247543 - DNA, 24 bp, Artificial sequence
  SiRNA target sequence
tagataaagaattttttaaggaca

SEQ ID NO: 247544 - DNA, 24 bp, Artificial sequence
  SiRNA target sequence
agataaagaattttttaaggacat

SEQ ID NO: 247545 - DNA, 24 bp, Artificial sequence
  SiRNA target sequence
gataaagaattttttaaggacata

SEQ ID NO: 247546 - DNA, 24 bp, Artificial sequence
  SiRNA target sequence
ataaagaattttttaaggacatat

SEQ ID NO: 247547 - DNA, 24 bp, Artificial sequence
  SiRNA target sequence
taaagaattttttaaggacatatc

SEQ ID NO: 247548 - DNA, 24 bp, Artificial sequence
  SiRNA target sequence
aaagaattttttaaggacatatca

SEQ ID NO: 247549 - DNA, 24 bp, Artificial sequence
  SiRNA target sequence
aagaattttttaaggacatatcaa

SEQ ID NO: 247550 - DNA, 24 bp, Artificial sequence
  SiRNA target sequence
agaattttttaaggacatatcaat

SEQ ID NO: 247551 - DNA, 24 bp, Artificial sequence
  SiRNA target sequence
gaattttttaaggacatatcaata

SEQ ID NO: 247552 - DNA, 24 bp, Artificial sequence
  SiRNA target sequence
aattttttaaggacatatcaataa

SEQ ID NO: 247553 - DNA, 24 bp, Artificial sequence
  SiRNA target sequence
attttttaaggacatatcaataaa

SEQ ID NO: 247554 - DNA, 24 bp, Artificial sequence
  SiRNA target sequence
ttttttaaggacatatcaataaat

SEQ ID NO: 247555 - DNA, 24 bp, Artificial sequence
  SiRNA target sequence
tttttaaggacatatcaataaatc

SEQ ID NO: 247556 - DNA, 24 bp, Artificial sequence
  SiRNA target sequence
ttttaaggacatatcaataaatcc

SEQ ID NO: 247557 - DNA, 24 bp, Artificial sequence
  SiRNA target sequence
tttaaggacatatcaataaatcct

SEQ ID NO: 247558 - DNA, 24 bp, Artificial sequence
  SiRNA target sequence
ttaaggacatatcaataaatcctg

SEQ ID NO: 247559 - DNA, 24 bp, Artificial sequence
  SiRNA target sequence
taaggacatatcaataaatcctgc

SEQ ID NO: 247560 - DNA, 24 bp, Artificial sequence
  SiRNA target sequence
aaggacatatcaataaatcctgca

SEQ ID NO: 247561 - DNA, 24 bp, Artificial sequence
  SiRNA target sequence
aggacatatcaataaatcctgcat

SEQ ID NO: 247562 - DNA, 24 bp, Artificial sequence
  SiRNA target sequence
ggacatatcaataaatcctgcatt

SEQ ID NO: 247563 - DNA, 24 bp, Artificial sequence
  SiRNA target sequence
gacatatcaataaatcctgcatta

SEQ ID NO: 247564 - DNA, 24 bp, Artificial sequence
  SiRNA target sequence
acatatcaataaatcctgcattaa

SEQ ID NO: 247565 - DNA, 24 bp, Artificial sequence
  SiRNA target sequence
catatcaataaatcctgcattaat

SEQ ID NO: 247566 - DNA, 24 bp, Artificial sequence
  SiRNA target sequence
atatcaataaatcctgcattaata

SEQ ID NO: 247567 - DNA, 24 bp, Artificial sequence
  SiRNA target sequence
tatcaataaatcctgcattaatag

SEQ ID NO: 247568 - DNA, 24 bp, Artificial sequence
  SiRNA target sequence
atcaataaatcctgcattaatagc

SEQ ID NO: 247569 - DNA, 24 bp, Artificial sequence
  SiRNA target sequence
tcaataaatcctgcattaatagca

SEQ ID NO: 247570 - DNA, 24 bp, Artificial sequence
  SiRNA target sequence
caataaatcctgcattaatagcat

SEQ ID NO: 247571 - DNA, 24 bp, Artificial sequence
  SiRNA target sequence
aataaatcctgcattaatagcata

SEQ ID NO: 247572 - DNA, 24 bp, Artificial sequence
  SiRNA target sequence
ataaatcctgcattaatagcatag

SEQ ID NO: 247573 - DNA, 24 bp, Artificial sequence
  SiRNA target sequence
taaatcctgcattaatagcataga

SEQ ID NO: 247574 - DNA, 24 bp, Artificial sequence
  SiRNA target sequence
aaatcctgcattaatagcatagat

SEQ ID NO: 247575 - DNA, 24 bp, Artificial sequence
  SiRNA target sequence
aatcctgcattaatagcatagatt

SEQ ID NO: 247576 - DNA, 24 bp, Artificial sequence
  SiRNA target sequence
atcctgcattaatagcatagatta

SEQ ID NO: 247577 - DNA, 24 bp, Artificial sequence
  SiRNA target sequence
tcctgcattaatagcatagattaa

SEQ ID NO: 247578 - DNA, 24 bp, Artificial sequence
  SiRNA target sequence
cctgcattaatagcatagattaat

SEQ ID NO: 247579 - DNA, 24 bp, Artificial sequence
  SiRNA target sequence
ctgcattaatagcatagattaatg

SEQ ID NO: 247580 - DNA, 24 bp, Artificial sequence
  SiRNA target sequence
tgcattaatagcatagattaatgc

SEQ ID NO: 247581 - DNA, 24 bp, Artificial sequence
  SiRNA target sequence
gcattaatagcatagattaatgcc

SEQ ID NO: 247582 - DNA, 24 bp, Artificial sequence
  SiRNA target sequence
cattaatagcatagattaatgccg

SEQ ID NO: 247583 - DNA, 24 bp, Artificial sequence
  SiRNA target sequence
attaatagcatagattaatgccgc

SEQ ID NO: 247584 - DNA, 24 bp, Artificial sequence
  SiRNA target sequence
ttaatagcatagattaatgccgct

SEQ ID NO: 247585 - DNA, 24 bp, Artificial sequence
  SiRNA target sequence
taatagcatagattaatgccgctg

SEQ ID NO: 247586 - DNA, 24 bp, Artificial sequence
  SiRNA target sequence
aatagcatagattaatgccgctgc

SEQ ID NO: 247587 - DNA, 24 bp, Artificial sequence
  SiRNA target sequence
atagcatagattaatgccgctgca

SEQ ID NO: 247588 - DNA, 24 bp, Artificial sequence
  SiRNA target sequence
tagcatagattaatgccgctgcac

SEQ ID NO: 247589 - DNA, 24 bp, Artificial sequence
  SiRNA target sequence
agcatagattaatgccgctgcaca

SEQ ID NO: 247590 - DNA, 24 bp, Artificial sequence
  SiRNA target sequence
gcatagattaatgccgctgcacac

SEQ ID NO: 247591 - DNA, 24 bp, Artificial sequence
  SiRNA target sequence
catagattaatgccgctgcacaca

SEQ ID NO: 247592 - DNA, 24 bp, Artificial sequence
  SiRNA target sequence
atagattaatgccgctgcacacat

SEQ ID NO: 247593 - DNA, 24 bp, Artificial sequence
  SiRNA target sequence
tagattaatgccgctgcacacata

SEQ ID NO: 247594 - DNA, 24 bp, Artificial sequence
  SiRNA target sequence
agattaatgccgctgcacacatat

SEQ ID NO: 247595 - DNA, 24 bp, Artificial sequence
  SiRNA target sequence
gattaatgccgctgcacacatatt

SEQ ID NO: 247596 - DNA, 24 bp, Artificial sequence
  SiRNA target sequence
attaatgccgctgcacacatattt

SEQ ID NO: 247597 - DNA, 24 bp, Artificial sequence
  SiRNA target sequence
ttaatgccgctgcacacatatttc

SEQ ID NO: 247598 - DNA, 24 bp, Artificial sequence
  SiRNA target sequence
taatgccgctgcacacatatttct

SEQ ID NO: 247599 - DNA, 24 bp, Artificial sequence
  SiRNA target sequence
aatgccgctgcacacatatttctt

SEQ ID NO: 247600 - DNA, 24 bp, Artificial sequence
  SiRNA target sequence
atgccgctgcacacatatttctta

SEQ ID NO: 247601 - DNA, 24 bp, Artificial sequence
  SiRNA target sequence
tgccgctgcacacatatttcttaa

SEQ ID NO: 247602 - DNA, 24 bp, Artificial sequence
  SiRNA target sequence
gccgctgcacacatatttcttaaa

SEQ ID NO: 247603 - DNA, 24 bp, Artificial sequence
  SiRNA target sequence
ccgctgcacacatatttcttaaaa

SEQ ID NO: 247604 - DNA, 24 bp, Artificial sequence
  SiRNA target sequence
cgctgcacacatatttcttaaaaa

SEQ ID NO: 247605 - DNA, 24 bp, Artificial sequence
  SiRNA target sequence
gctgcacacatatttcttaaaaat

SEQ ID NO: 247606 - DNA, 24 bp, Artificial sequence
  SiRNA target sequence
ctgcacacatatttcttaaaaatt

SEQ ID NO: 247607 - DNA, 24 bp, Artificial sequence
  SiRNA target sequence
tgcacacatatttcttaaaaattt

SEQ ID NO: 247608 - DNA, 24 bp, Artificial sequence
  SiRNA target sequence
gcacacatatttcttaaaaatttg

SEQ ID NO: 247609 - DNA, 24 bp, Artificial sequence
  SiRNA target sequence
cacacatatttcttaaaaatttgg

SEQ ID NO: 247610 - DNA, 24 bp, Artificial sequence
  SiRNA target sequence
acacatatttcttaaaaatttgga

SEQ ID NO: 247611 - DNA, 24 bp, Artificial sequence
  SiRNA target sequence
cacatatttcttaaaaatttggat

SEQ ID NO: 247612 - DNA, 24 bp, Artificial sequence
  SiRNA target sequence
acatatttcttaaaaatttggatt

SEQ ID NO: 247613 - DNA, 24 bp, Artificial sequence
  SiRNA target sequence
catatttcttaaaaatttggattg

SEQ ID NO: 247614 - DNA, 24 bp, Artificial sequence
  SiRNA target sequence
atatttcttaaaaatttggattgt

SEQ ID NO: 247615 - DNA, 24 bp, Artificial sequence
  SiRNA target sequence
tatttcttaaaaatttggattgta

SEQ ID NO: 247616 - DNA, 24 bp, Artificial sequence
  SiRNA target sequence
atttcttaaaaatttggattgtaa

SEQ ID NO: 247617 - DNA, 24 bp, Artificial sequence
  SiRNA target sequence
tttcttaaaaatttggattgtaaa

SEQ ID NO: 247618 - DNA, 24 bp, Artificial sequence
  SiRNA target sequence
ttcttaaaaatttggattgtaaaa

SEQ ID NO: 247619 - DNA, 24 bp, Artificial sequence
  SiRNA target sequence
tcttaaaaatttggattgtaaaag

SEQ ID NO: 247620 - DNA, 24 bp, Artificial sequence
  SiRNA target sequence
cttaaaaatttggattgtaaaaga

SEQ ID NO: 247621 - DNA, 24 bp, Artificial sequence
  SiRNA target sequence
ttaaaaatttggattgtaaaagat

SEQ ID NO: 247622 - DNA, 24 bp, Artificial sequence
  SiRNA target sequence
taaaaatttggattgtaaaagatc

SEQ ID NO: 247623 - DNA, 24 bp, Artificial sequence
  SiRNA target sequence
aaaaatttggattgtaaaagatca

SEQ ID NO: 247624 - DNA, 24 bp, Artificial sequence
  SiRNA target sequence
aaaatttggattgtaaaagatcaa

SEQ ID NO: 247625 - DNA, 24 bp, Artificial sequence
  SiRNA target sequence
aaatttggattgtaaaagatcaaa

SEQ ID NO: 247626 - DNA, 24 bp, Artificial sequence
  SiRNA target sequence
aatttggattgtaaaagatcaaac

SEQ ID NO: 247627 - DNA, 24 bp, Artificial sequence
  SiRNA target sequence
atttggattgtaaaagatcaaacg

SEQ ID NO: 247628 - DNA, 24 bp, Artificial sequence
  SiRNA target sequence
tttggattgtaaaagatcaaacga

SEQ ID NO: 247629 - DNA, 24 bp, Artificial sequence
  SiRNA target sequence
ttggattgtaaaagatcaaacgag

SEQ ID NO: 247630 - DNA, 24 bp, Artificial sequence
  SiRNA target sequence
tggattgtaaaagatcaaacgagg

SEQ ID NO: 247631 - DNA, 24 bp, Artificial sequence
  SiRNA target sequence
ggattgtaaaagatcaaacgagga

SEQ ID NO: 247632 - DNA, 24 bp, Artificial sequence
  SiRNA target sequence
gattgtaaaagatcaaacgaggat

SEQ ID NO: 247633 - DNA, 24 bp, Artificial sequence
  SiRNA target sequence
attgtaaaagatcaaacgaggatg

SEQ ID NO: 247634 - DNA, 24 bp, Artificial sequence
  SiRNA target sequence
ttgtaaaagatcaaacgaggatgt

SEQ ID NO: 247635 - DNA, 24 bp, Artificial sequence
  SiRNA target sequence
tgtaaaagatcaaacgaggatgtc

SEQ ID NO: 247636 - DNA, 24 bp, Artificial sequence
  SiRNA target sequence
gtaaaagatcaaacgaggatgtcg

SEQ ID NO: 247637 - DNA, 24 bp, Artificial sequence
  SiRNA target sequence
taaaagatcaaacgaggatgtcgt

SEQ ID NO: 247638 - DNA, 24 bp, Artificial sequence
  SiRNA target sequence
aaaagatcaaacgaggatgtcgtt

SEQ ID NO: 247639 - DNA, 24 bp, Artificial sequence
  SiRNA target sequence
aaagatcaaacgaggatgtcgttt

SEQ ID NO: 247640 - DNA, 24 bp, Artificial sequence
  SiRNA target sequence
aagatcaaacgaggatgtcgtttt

SEQ ID NO: 247641 - DNA, 24 bp, Artificial sequence
  SiRNA target sequence
agatcaaacgaggatgtcgttttg

SEQ ID NO: 247642 - DNA, 24 bp, Artificial sequence
  SiRNA target sequence
gatcaaacgaggatgtcgttttgt

SEQ ID NO: 247643 - DNA, 24 bp, Artificial sequence
  SiRNA target sequence
atcaaacgaggatgtcgttttgtc

SEQ ID NO: 247644 - DNA, 24 bp, Artificial sequence
  SiRNA target sequence
tcaaacgaggatgtcgttttgtct

SEQ ID NO: 247645 - DNA, 24 bp, Artificial sequence
  SiRNA target sequence
caaacgaggatgtcgttttgtctt

SEQ ID NO: 247646 - DNA, 24 bp, Artificial sequence
  SiRNA target sequence
aaacgaggatgtcgttttgtcttc

SEQ ID NO: 247647 - DNA, 24 bp, Artificial sequence
  SiRNA target sequence
aacgaggatgtcgttttgtcttct

SEQ ID NO: 247648 - DNA, 24 bp, Artificial sequence
  SiRNA target sequence
acgaggatgtcgttttgtcttctt

SEQ ID NO: 247649 - DNA, 24 bp, Artificial sequence
  SiRNA target sequence
cgaggatgtcgttttgtcttcttc

SEQ ID NO: 247650 - DNA, 24 bp, Artificial sequence
  SiRNA target sequence
gaggatgtcgttttgtcttcttct

SEQ ID NO: 247651 - DNA, 24 bp, Artificial sequence
  SiRNA target sequence
aggatgtcgttttgtcttcttctt

SEQ ID NO: 247652 - DNA, 24 bp, Artificial sequence
  SiRNA target sequence
ggatgtcgttttgtcttcttcttt

SEQ ID NO: 247653 - DNA, 24 bp, Artificial sequence
  SiRNA target sequence
gatgtcgttttgtcttcttcttta

SEQ ID NO: 247654 - DNA, 24 bp, Artificial sequence
  SiRNA target sequence
atgtcgttttgtcttcttctttat

SEQ ID NO: 247655 - DNA, 24 bp, Artificial sequence
  SiRNA target sequence
tgtcgttttgtcttcttctttatt

SEQ ID NO: 247656 - DNA, 24 bp, Artificial sequence
  SiRNA target sequence
gtcgttttgtcttcttctttattt

SEQ ID NO: 247657 - DNA, 24 bp, Artificial sequence
  SiRNA target sequence
tcgttttgtcttcttctttattta

SEQ ID NO: 247658 - DNA, 24 bp, Artificial sequence
  SiRNA target sequence
cgttttgtcttcttctttatttat

SEQ ID NO: 247659 - DNA, 24 bp, Artificial sequence
  SiRNA target sequence
gttttgtcttcttctttatttata

SEQ ID NO: 247660 - DNA, 24 bp, Artificial sequence
  SiRNA target sequence
ttttgtcttcttctttatttatag

SEQ ID NO: 247661 - DNA, 24 bp, Artificial sequence
  SiRNA target sequence
tttgtcttcttctttatttatagt

SEQ ID NO: 247662 - DNA, 24 bp, Artificial sequence
  SiRNA target sequence
ttgtcttcttctttatttatagtt

SEQ ID NO: 247663 - DNA, 24 bp, Artificial sequence
  SiRNA target sequence
tgtcttcttctttatttatagttt

SEQ ID NO: 247664 - DNA, 24 bp, Artificial sequence
  SiRNA target sequence
gtcttcttctttatttatagtttc

SEQ ID NO: 247665 - DNA, 24 bp, Artificial sequence
  SiRNA target sequence
tcttcttctttatttatagtttcc

SEQ ID NO: 247666 - DNA, 24 bp, Artificial sequence
  SiRNA target sequence
cttcttctttatttatagtttcct

SEQ ID NO: 247667 - DNA, 24 bp, Artificial sequence
  SiRNA target sequence
ttcttctttatttatagtttcctt

SEQ ID NO: 247668 - DNA, 24 bp, Artificial sequence
  SiRNA target sequence
tcttctttatttatagtttccttt

SEQ ID NO: 247669 - DNA, 24 bp, Artificial sequence
  SiRNA target sequence
cttctttatttatagtttccttta

SEQ ID NO: 247670 - DNA, 24 bp, Artificial sequence
  SiRNA target sequence
ttctttatttatagtttcctttat

SEQ ID NO: 247671 - DNA, 24 bp, Artificial sequence
  SiRNA target sequence
tctttatttatagtttcctttatt

SEQ ID NO: 247672 - DNA, 24 bp, Artificial sequence
  SiRNA target sequence
ctttatttatagtttcctttattt

SEQ ID NO: 247673 - DNA, 24 bp, Artificial sequence
  SiRNA target sequence
tttatttatagtttcctttatttc

SEQ ID NO: 247674 - DNA, 24 bp, Artificial sequence
  SiRNA target sequence
ttatttatagtttcctttatttct

SEQ ID NO: 247675 - DNA, 24 bp, Artificial sequence
  SiRNA target sequence
tatttatagtttcctttatttctt

SEQ ID NO: 247676 - DNA, 24 bp, Artificial sequence
  SiRNA target sequence
atttatagtttcctttatttcttt

SEQ ID NO: 247677 - DNA, 24 bp, Artificial sequence
  SiRNA target sequence
tttatagtttcctttatttcttta

SEQ ID NO: 247678 - DNA, 24 bp, Artificial sequence
  SiRNA target sequence
ttatagtttcctttatttctttag

SEQ ID NO: 247679 - DNA, 24 bp, Artificial sequence
  SiRNA target sequence
tatagtttcctttatttctttagt

SEQ ID NO: 247680 - DNA, 24 bp, Artificial sequence
  SiRNA target sequence
atagtttcctttatttctttagtt

SEQ ID NO: 247681 - DNA, 24 bp, Artificial sequence
  SiRNA target sequence
tagtttcctttatttctttagttt

SEQ ID NO: 247682 - DNA, 24 bp, Artificial sequence
  SiRNA target sequence
agtttcctttatttctttagtttt

SEQ ID NO: 247683 - DNA, 24 bp, Artificial sequence
  SiRNA target sequence
gtttcctttatttctttagtttta

SEQ ID NO: 247684 - DNA, 24 bp, Artificial sequence
  SiRNA target sequence
tttcctttatttctttagttttaa

SEQ ID NO: 247685 - DNA, 24 bp, Artificial sequence
  SiRNA target sequence
ttcctttatttctttagttttaag

SEQ ID NO: 247686 - DNA, 24 bp, Artificial sequence
  SiRNA target sequence
tcctttatttctttagttttaaga

SEQ ID NO: 247687 - DNA, 24 bp, Artificial sequence
  SiRNA target sequence
cctttatttctttagttttaagag

SEQ ID NO: 247688 - DNA, 24 bp, Artificial sequence
  SiRNA target sequence
ctttatttctttagttttaagagg

SEQ ID NO: 247689 - DNA, 24 bp, Artificial sequence
  SiRNA target sequence
tttatttctttagttttaagagga

SEQ ID NO: 247690 - DNA, 24 bp, Artificial sequence
  SiRNA target sequence
ttatttctttagttttaagaggaa

SEQ ID NO: 247691 - DNA, 24 bp, Artificial sequence
  SiRNA target sequence
tatttctttagttttaagaggaat

SEQ ID NO: 247692 - DNA, 24 bp, Artificial sequence
  SiRNA target sequence
atttctttagttttaagaggaata

SEQ ID NO: 247693 - DNA, 24 bp, Artificial sequence
  SiRNA target sequence
tttctttagttttaagaggaatat

SEQ ID NO: 247694 - DNA, 24 bp, Artificial sequence
  SiRNA target sequence
ttctttagttttaagaggaatata

SEQ ID NO: 247695 - DNA, 24 bp, Artificial sequence
  SiRNA target sequence
tctttagttttaagaggaatataa

SEQ ID NO: 247696 - DNA, 24 bp, Artificial sequence
  SiRNA target sequence
ctttagttttaagaggaatataac

SEQ ID NO: 247697 - DNA, 24 bp, Artificial sequence
  SiRNA target sequence
tttagttttaagaggaatataact

SEQ ID NO: 247698 - DNA, 24 bp, Artificial sequence
  SiRNA target sequence
ttagttttaagaggaatataactt

SEQ ID NO: 247699 - DNA, 24 bp, Artificial sequence
  SiRNA target sequence
tagttttaagaggaatataacttt

SEQ ID NO: 247700 - DNA, 24 bp, Artificial sequence
  SiRNA target sequence
agttttaagaggaatataactttt

SEQ ID NO: 247701 - DNA, 24 bp, Artificial sequence
  SiRNA target sequence
gttttaagaggaatataacttttt

SEQ ID NO: 247702 - DNA, 24 bp, Artificial sequence
  SiRNA target sequence
ttttaagaggaatataacttttta

SEQ ID NO: 247703 - DNA, 24 bp, Artificial sequence
  SiRNA target sequence
tttaagaggaatataactttttaa

SEQ ID NO: 247704 - DNA, 24 bp, Artificial sequence
  SiRNA target sequence
ttaagaggaatataactttttaaa

SEQ ID NO: 247705 - DNA, 24 bp, Artificial sequence
  SiRNA target sequence
taagaggaatataactttttaaaa

SEQ ID NO: 247706 - DNA, 24 bp, Artificial sequence
  SiRNA target sequence
aagaggaatataactttttaaaaa

SEQ ID NO: 247707 - DNA, 24 bp, Artificial sequence
  SiRNA target sequence
agaggaatataactttttaaaaag

SEQ ID NO: 247708 - DNA, 24 bp, Artificial sequence
  SiRNA target sequence
gaggaatataactttttaaaaagt

SEQ ID NO: 247709 - DNA, 24 bp, Artificial sequence
  SiRNA target sequence
aggaatataactttttaaaaagta

SEQ ID NO: 247710 - DNA, 24 bp, Artificial sequence
  SiRNA target sequence
ggaatataactttttaaaaagtaa

SEQ ID NO: 247711 - DNA, 24 bp, Artificial sequence
  SiRNA target sequence
gaatataactttttaaaaagtaaa

SEQ ID NO: 247712 - DNA, 24 bp, Artificial sequence
  SiRNA target sequence
aatataactttttaaaaagtaaat

SEQ ID NO: 247713 - DNA, 24 bp, Artificial sequence
  SiRNA target sequence
atataactttttaaaaagtaaatt

SEQ ID NO: 247714 - DNA, 24 bp, Artificial sequence
  SiRNA target sequence
tataactttttaaaaagtaaatta

SEQ ID NO: 247715 - DNA, 24 bp, Artificial sequence
  SiRNA target sequence
ataactttttaaaaagtaaattaa

SEQ ID NO: 247716 - DNA, 24 bp, Artificial sequence
  SiRNA target sequence
taactttttaaaaagtaaattaat

SEQ ID NO: 247717 - DNA, 24 bp, Artificial sequence
  SiRNA target sequence
aactttttaaaaagtaaattaatg

SEQ ID NO: 247718 - DNA, 24 bp, Artificial sequence
  SiRNA target sequence
actttttaaaaagtaaattaatgt

SEQ ID NO: 247719 - DNA, 24 bp, Artificial sequence
  SiRNA target sequence
ctttttaaaaagtaaattaatgta

SEQ ID NO: 247720 - DNA, 24 bp, Artificial sequence
  SiRNA target sequence
tttttaaaaagtaaattaatgtag

SEQ ID NO: 247721 - DNA, 24 bp, Artificial sequence
  SiRNA target sequence
ttttaaaaagtaaattaatgtagt

SEQ ID NO: 247722 - DNA, 24 bp, Artificial sequence
  SiRNA target sequence
tttaaaaagtaaattaatgtagtt

SEQ ID NO: 247723 - DNA, 24 bp, Artificial sequence
  SiRNA target sequence
ttaaaaagtaaattaatgtagtta

SEQ ID NO: 247724 - DNA, 24 bp, Artificial sequence
  SiRNA target sequence
taaaaagtaaattaatgtagttac

SEQ ID NO: 247725 - DNA, 24 bp, Artificial sequence
  SiRNA target sequence
aaaaagtaaattaatgtagttaca

SEQ ID NO: 247726 - DNA, 24 bp, Artificial sequence
  SiRNA target sequence
aaaagtaaattaatgtagttacaa

SEQ ID NO: 247727 - DNA, 24 bp, Artificial sequence
  SiRNA target sequence
aaagtaaattaatgtagttacaaa

SEQ ID NO: 247728 - DNA, 24 bp, Artificial sequence
  SiRNA target sequence
aagtaaattaatgtagttacaaaa

SEQ ID NO: 247729 - DNA, 24 bp, Artificial sequence
  SiRNA target sequence
agtaaattaatgtagttacaaaag

SEQ ID NO: 247730 - DNA, 24 bp, Artificial sequence
  SiRNA target sequence
gtaaattaatgtagttacaaaaga

SEQ ID NO: 247731 - DNA, 24 bp, Artificial sequence
  SiRNA target sequence
taaattaatgtagttacaaaagac

SEQ ID NO: 247732 - DNA, 24 bp, Artificial sequence
  SiRNA target sequence
aaattaatgtagttacaaaagaca

SEQ ID NO: 247733 - DNA, 24 bp, Artificial sequence
  SiRNA target sequence
aattaatgtagttacaaaagacaa

SEQ ID NO: 247734 - DNA, 24 bp, Artificial sequence
  SiRNA target sequence
attaatgtagttacaaaagacaag

SEQ ID NO: 247735 - DNA, 24 bp, Artificial sequence
  SiRNA target sequence
ttaatgtagttacaaaagacaaga

SEQ ID NO: 247736 - DNA, 24 bp, Artificial sequence
  SiRNA target sequence
taatgtagttacaaaagacaagat

SEQ ID NO: 247737 - DNA, 24 bp, Artificial sequence
  SiRNA target sequence
aatgtagttacaaaagacaagatc

SEQ ID NO: 247738 - DNA, 24 bp, Artificial sequence
  SiRNA target sequence
atgtagttacaaaagacaagatca

SEQ ID NO: 247739 - DNA, 24 bp, Artificial sequence
  SiRNA target sequence
tgtagttacaaaagacaagatcaa

SEQ ID NO: 247740 - DNA, 24 bp, Artificial sequence
  SiRNA target sequence
gtagttacaaaagacaagatcaaa

SEQ ID NO: 247741 - DNA, 24 bp, Artificial sequence
  SiRNA target sequence
tagttacaaaagacaagatcaaaa

SEQ ID NO: 247742 - DNA, 24 bp, Artificial sequence
  SiRNA target sequence
agttacaaaagacaagatcaaaaa

SEQ ID NO: 247743 - DNA, 24 bp, Artificial sequence
  SiRNA target sequence
gttacaaaagacaagatcaaaaaa

SEQ ID NO: 247744 - DNA, 24 bp, Artificial sequence
  SiRNA target sequence
ttacaaaagacaagatcaaaaaaa

SEQ ID NO: 247745 - DNA, 24 bp, Artificial sequence
  SiRNA target sequence
tacaaaagacaagatcaaaaaaaa

SEQ ID NO: 247746 - DNA, 24 bp, Artificial sequence
  SiRNA target sequence
acaaaagacaagatcaaaaaaaac

SEQ ID NO: 247747 - DNA, 24 bp, Artificial sequence
  SiRNA target sequence
caaaagacaagatcaaaaaaaaca

SEQ ID NO: 247748 - DNA, 24 bp, Artificial sequence
  SiRNA target sequence
aaaagacaagatcaaaaaaaacaa

SEQ ID NO: 247749 - DNA, 24 bp, Artificial sequence
  SiRNA target sequence
aaagacaagatcaaaaaaaacaaa

SEQ ID NO: 247750 - DNA, 24 bp, Artificial sequence
  SiRNA target sequence
aagacaagatcaaaaaaaacaaac

SEQ ID NO: 247751 - DNA, 24 bp, Artificial sequence
  SiRNA target sequence
agacaagatcaaaaaaaacaaact

SEQ ID NO: 247752 - DNA, 24 bp, Artificial sequence
  SiRNA target sequence
gacaagatcaaaaaaaacaaacta

SEQ ID NO: 247753 - DNA, 24 bp, Artificial sequence
  SiRNA target sequence
acaagatcaaaaaaaacaaactac

SEQ ID NO: 247754 - DNA, 24 bp, Artificial sequence
  SiRNA target sequence
caagatcaaaaaaaacaaactact

SEQ ID NO: 247755 - DNA, 24 bp, Artificial sequence
  SiRNA target sequence
aagatcaaaaaaaacaaactacta

SEQ ID NO: 247756 - DNA, 24 bp, Artificial sequence
  SiRNA target sequence
agatcaaaaaaaacaaactactac

SEQ ID NO: 247757 - DNA, 24 bp, Artificial sequence
  SiRNA target sequence
gatcaaaaaaaacaaactactacc

SEQ ID NO: 247758 - DNA, 24 bp, Artificial sequence
  SiRNA target sequence
atcaaaaaaaacaaactactaccg

SEQ ID NO: 247759 - DNA, 24 bp, Artificial sequence
  SiRNA target sequence
tcaaaaaaaacaaactactaccgt

SEQ ID NO: 247760 - DNA, 24 bp, Artificial sequence
  SiRNA target sequence
caaaaaaaacaaactactaccgtc

SEQ ID NO: 247761 - DNA, 24 bp, Artificial sequence
  SiRNA target sequence
aaaaaaaacaaactactaccgtca

SEQ ID NO: 247762 - DNA, 24 bp, Artificial sequence
  SiRNA target sequence
aaaaaaacaaactactaccgtcaa

SEQ ID NO: 247763 - DNA, 24 bp, Artificial sequence
  SiRNA target sequence
aaaaaacaaactactaccgtcaat

SEQ ID NO: 247764 - DNA, 24 bp, Artificial sequence
  SiRNA target sequence
aaaaacaaactactaccgtcaatt

SEQ ID NO: 247765 - DNA, 24 bp, Artificial sequence
  SiRNA target sequence
aaaacaaactactaccgtcaattt

SEQ ID NO: 247766 - DNA, 24 bp, Artificial sequence
  SiRNA target sequence
aaacaaactactaccgtcaatttt

SEQ ID NO: 247767 - DNA, 24 bp, Artificial sequence
  SiRNA target sequence
aacaaactactaccgtcaatttta

SEQ ID NO: 247768 - DNA, 24 bp, Artificial sequence
  SiRNA target sequence
acaaactactaccgtcaattttat

SEQ ID NO: 247769 - DNA, 24 bp, Artificial sequence
  SiRNA target sequence
caaactactaccgtcaattttatc

SEQ ID NO: 247770 - DNA, 24 bp, Artificial sequence
  SiRNA target sequence
aaactactaccgtcaattttatca

SEQ ID NO: 247771 - DNA, 24 bp, Artificial sequence
  SiRNA target sequence
aactactaccgtcaattttatcat

SEQ ID NO: 247772 - DNA, 24 bp, Artificial sequence
  SiRNA target sequence
actactaccgtcaattttatcatg

SEQ ID NO: 247773 - DNA, 24 bp, Artificial sequence
  SiRNA target sequence
ctactaccgtcaattttatcatgc

SEQ ID NO: 247774 - DNA, 24 bp, Artificial sequence
  SiRNA target sequence
tactaccgtcaattttatcatgca

SEQ ID NO: 247775 - DNA, 24 bp, Artificial sequence
  SiRNA target sequence
actaccgtcaattttatcatgcaa

SEQ ID NO: 247776 - DNA, 24 bp, Artificial sequence
  SiRNA target sequence
ctaccgtcaattttatcatgcaaa

SEQ ID NO: 247777 - DNA, 24 bp, Artificial sequence
  SiRNA target sequence
taccgtcaattttatcatgcaaac

SEQ ID NO: 247778 - DNA, 24 bp, Artificial sequence
  SiRNA target sequence
accgtcaattttatcatgcaaacc

SEQ ID NO: 247779 - DNA, 24 bp, Artificial sequence
  SiRNA target sequence
ccgtcaattttatcatgcaaacct

SEQ ID NO: 247780 - DNA, 24 bp, Artificial sequence
  SiRNA target sequence
cgtcaattttatcatgcaaacctg

SEQ ID NO: 247781 - DNA, 24 bp, Artificial sequence
  SiRNA target sequence
gtcaattttatcatgcaaacctgc

SEQ ID NO: 247782 - DNA, 24 bp, Artificial sequence
  SiRNA target sequence
tcaattttatcatgcaaacctgca

SEQ ID NO: 247783 - DNA, 24 bp, Artificial sequence
  SiRNA target sequence
caattttatcatgcaaacctgcag

SEQ ID NO: 247784 - DNA, 24 bp, Artificial sequence
  SiRNA target sequence
aattttatcatgcaaacctgcagg

SEQ ID NO: 247785 - DNA, 24 bp, Artificial sequence
  SiRNA target sequence
attttatcatgcaaacctgcagga

SEQ ID NO: 247786 - DNA, 24 bp, Artificial sequence
  SiRNA target sequence
ttttatcatgcaaacctgcaggaa

SEQ ID NO: 247787 - DNA, 24 bp, Artificial sequence
  SiRNA target sequence
tttatcatgcaaacctgcaggaag

SEQ ID NO: 247788 - DNA, 24 bp, Artificial sequence
  SiRNA target sequence
ttatcatgcaaacctgcaggaagt

SEQ ID NO: 247789 - DNA, 24 bp, Artificial sequence
  SiRNA target sequence
tatcatgcaaacctgcaggaagta

SEQ ID NO: 247790 - DNA, 24 bp, Artificial sequence
  SiRNA target sequence
atcatgcaaacctgcaggaagtat

SEQ ID NO: 247791 - DNA, 24 bp, Artificial sequence
  SiRNA target sequence
tcatgcaaacctgcaggaagtata

SEQ ID NO: 247792 - DNA, 24 bp, Artificial sequence
  SiRNA target sequence
catgcaaacctgcaggaagtatat

SEQ ID NO: 247793 - DNA, 24 bp, Artificial sequence
  SiRNA target sequence
atgcaaacctgcaggaagtatatt

SEQ ID NO: 247794 - DNA, 24 bp, Artificial sequence
  SiRNA target sequence
tgcaaacctgcaggaagtatattt

SEQ ID NO: 247795 - DNA, 24 bp, Artificial sequence
  SiRNA target sequence
gcaaacctgcaggaagtatatttg

SEQ ID NO: 247796 - DNA, 24 bp, Artificial sequence
  SiRNA target sequence
caaacctgcaggaagtatatttgc

SEQ ID NO: 247797 - DNA, 24 bp, Artificial sequence
  SiRNA target sequence
aaacctgcaggaagtatatttgct

SEQ ID NO: 247798 - DNA, 24 bp, Artificial sequence
  SiRNA target sequence
aacctgcaggaagtatatttgcta

SEQ ID NO: 247799 - DNA, 24 bp, Artificial sequence
  SiRNA target sequence
acctgcaggaagtatatttgctaa

SEQ ID NO: 247800 - DNA, 24 bp, Artificial sequence
  SiRNA target sequence
cctgcaggaagtatatttgctaat

SEQ ID NO: 247801 - DNA, 24 bp, Artificial sequence
  SiRNA target sequence
ctgcaggaagtatatttgctaatt

SEQ ID NO: 247802 - DNA, 24 bp, Artificial sequence
  SiRNA target sequence
tgcaggaagtatatttgctaattc

SEQ ID NO: 247803 - DNA, 24 bp, Artificial sequence
  SiRNA target sequence
gcaggaagtatatttgctaattca

SEQ ID NO: 247804 - DNA, 24 bp, Artificial sequence
  SiRNA target sequence
caggaagtatatttgctaattcat

SEQ ID NO: 247805 - DNA, 24 bp, Artificial sequence
  SiRNA target sequence
aggaagtatatttgctaattcatc

SEQ ID NO: 247806 - DNA, 24 bp, Artificial sequence
  SiRNA target sequence
ggaagtatatttgctaattcatct

SEQ ID NO: 247807 - DNA, 24 bp, Artificial sequence
  SiRNA target sequence
gaagtatatttgctaattcatctt

SEQ ID NO: 247808 - DNA, 24 bp, Artificial sequence
  SiRNA target sequence
aagtatatttgctaattcatcttt

SEQ ID NO: 247809 - DNA, 24 bp, Artificial sequence
  SiRNA target sequence
agtatatttgctaattcatctttt

SEQ ID NO: 247810 - DNA, 24 bp, Artificial sequence
  SiRNA target sequence
gtatatttgctaattcatctttta

SEQ ID NO: 247811 - DNA, 24 bp, Artificial sequence
  SiRNA target sequence
tatatttgctaattcatcttttat

SEQ ID NO: 247812 - DNA, 24 bp, Artificial sequence
  SiRNA target sequence
atatttgctaattcatcttttata

SEQ ID NO: 247813 - DNA, 24 bp, Artificial sequence
  SiRNA target sequence
tatttgctaattcatcttttatat

SEQ ID NO: 247814 - DNA, 24 bp, Artificial sequence
  SiRNA target sequence
atttgctaattcatcttttatata

SEQ ID NO: 247815 - DNA, 24 bp, Artificial sequence
  SiRNA target sequence
tttgctaattcatcttttatataa

SEQ ID NO: 247816 - DNA, 24 bp, Artificial sequence
  SiRNA target sequence
ttgctaattcatcttttatataaa

SEQ ID NO: 247817 - DNA, 24 bp, Artificial sequence
  SiRNA target sequence
tgctaattcatcttttatataaat

SEQ ID NO: 247818 - DNA, 24 bp, Artificial sequence
  SiRNA target sequence
gctaattcatcttttatataaata

SEQ ID NO: 247819 - DNA, 24 bp, Artificial sequence
  SiRNA target sequence
ctaattcatcttttatataaataa

SEQ ID NO: 247820 - DNA, 24 bp, Artificial sequence
  SiRNA target sequence
taattcatcttttatataaataaa

SEQ ID NO: 247821 - DNA, 24 bp, Artificial sequence
  SiRNA target sequence
aattcatcttttatataaataaaa

SEQ ID NO: 247822 - DNA, 24 bp, Artificial sequence
  SiRNA target sequence
attcatcttttatataaataaaag

SEQ ID NO: 247823 - DNA, 24 bp, Artificial sequence
  SiRNA target sequence
ttcatcttttatataaataaaagc

SEQ ID NO: 247824 - DNA, 24 bp, Artificial sequence
  SiRNA target sequence
tcatcttttatataaataaaagct

SEQ ID NO: 247825 - DNA, 24 bp, Artificial sequence
  SiRNA target sequence
catcttttatataaataaaagcta

SEQ ID NO: 247826 - DNA, 24 bp, Artificial sequence
  SiRNA target sequence
atcttttatataaataaaagctac

SEQ ID NO: 247827 - DNA, 24 bp, Artificial sequence
  SiRNA target sequence
tcttttatataaataaaagctaca

SEQ ID NO: 247828 - DNA, 24 bp, Artificial sequence
  SiRNA target sequence
cttttatataaataaaagctacag

SEQ ID NO: 247829 - DNA, 24 bp, Artificial sequence
  SiRNA target sequence
ttttatataaataaaagctacaga

SEQ ID NO: 247830 - DNA, 24 bp, Artificial sequence
  SiRNA target sequence
tttatataaataaaagctacagaa

SEQ ID NO: 247831 - DNA, 24 bp, Artificial sequence
  SiRNA target sequence
ttatataaataaaagctacagaaa

SEQ ID NO: 247832 - DNA, 24 bp, Artificial sequence
  SiRNA target sequence
tatataaataaaagctacagaaat

SEQ ID NO: 247833 - DNA, 24 bp, Artificial sequence
  SiRNA target sequence
atataaataaaagctacagaaata

SEQ ID NO: 247834 - DNA, 24 bp, Artificial sequence
  SiRNA target sequence
tataaataaaagctacagaaataa

SEQ ID NO: 247835 - DNA, 24 bp, Artificial sequence
  SiRNA target sequence
ataaataaaagctacagaaataat

SEQ ID NO: 247836 - DNA, 24 bp, Artificial sequence
  SiRNA target sequence
taaataaaagctacagaaataatc

SEQ ID NO: 247837 - DNA, 24 bp, Artificial sequence
  SiRNA target sequence
aaataaaagctacagaaataatca

SEQ ID NO: 247838 - DNA, 24 bp, Artificial sequence
  SiRNA target sequence
aataaaagctacagaaataatcat

SEQ ID NO: 247839 - DNA, 24 bp, Artificial sequence
  SiRNA target sequence
ataaaagctacagaaataatcatt

SEQ ID NO: 247840 - DNA, 24 bp, Artificial sequence
  SiRNA target sequence
taaaagctacagaaataatcattg

SEQ ID NO: 247841 - DNA, 24 bp, Artificial sequence
  SiRNA target sequence
aaaagctacagaaataatcattga

SEQ ID NO: 247842 - DNA, 24 bp, Artificial sequence
  SiRNA target sequence
aaagctacagaaataatcattgaa

SEQ ID NO: 247843 - DNA, 24 bp, Artificial sequence
  SiRNA target sequence
aagctacagaaataatcattgaaa

SEQ ID NO: 247844 - DNA, 24 bp, Artificial sequence
  SiRNA target sequence
agctacagaaataatcattgaaat

SEQ ID NO: 247845 - DNA, 24 bp, Artificial sequence
  SiRNA target sequence
gctacagaaataatcattgaaatg

SEQ ID NO: 247846 - DNA, 24 bp, Artificial sequence
  SiRNA target sequence
ctacagaaataatcattgaaatgg

SEQ ID NO: 247847 - DNA, 24 bp, Artificial sequence
  SiRNA target sequence
tacagaaataatcattgaaatggc

SEQ ID NO: 247848 - DNA, 24 bp, Artificial sequence
  SiRNA target sequence
acagaaataatcattgaaatggcg

SEQ ID NO: 247849 - DNA, 24 bp, Artificial sequence
  SiRNA target sequence
cagaaataatcattgaaatggcgg

SEQ ID NO: 247850 - DNA, 24 bp, Artificial sequence
  SiRNA target sequence
agaaataatcattgaaatggcggt

SEQ ID NO: 247851 - DNA, 24 bp, Artificial sequence
  SiRNA target sequence
gaaataatcattgaaatggcggtg

SEQ ID NO: 247852 - DNA, 24 bp, Artificial sequence
  SiRNA target sequence
aaataatcattgaaatggcggtga

SEQ ID NO: 247853 - DNA, 24 bp, Artificial sequence
  SiRNA target sequence
aataatcattgaaatggcggtgat

SEQ ID NO: 247854 - DNA, 24 bp, Artificial sequence
  SiRNA target sequence
ataatcattgaaatggcggtgatt

SEQ ID NO: 247855 - DNA, 24 bp, Artificial sequence
  SiRNA target sequence
taatcattgaaatggcggtgattg

SEQ ID NO: 247856 - DNA, 24 bp, Artificial sequence
  SiRNA target sequence
aatcattgaaatggcggtgattgt

SEQ ID NO: 247857 - DNA, 24 bp, Artificial sequence
  SiRNA target sequence
atcattgaaatggcggtgattgtg

SEQ ID NO: 247858 - DNA, 24 bp, Artificial sequence
  SiRNA target sequence
tcattgaaatggcggtgattgtgg

SEQ ID NO: 247859 - DNA, 24 bp, Artificial sequence
  SiRNA target sequence
cattgaaatggcggtgattgtgga

SEQ ID NO: 247860 - DNA, 24 bp, Artificial sequence
  SiRNA target sequence
attgaaatggcggtgattgtggaa

SEQ ID NO: 247861 - DNA, 24 bp, Artificial sequence
  SiRNA target sequence
ttgaaatggcggtgattgtggaaa

SEQ ID NO: 247862 - DNA, 24 bp, Artificial sequence
  SiRNA target sequence
tgaaatggcggtgattgtggaaaa

SEQ ID NO: 247863 - DNA, 24 bp, Artificial sequence
  SiRNA target sequence
gaaatggcggtgattgtggaaaaa

SEQ ID NO: 247864 - DNA, 24 bp, Artificial sequence
  SiRNA target sequence
aaatggcggtgattgtggaaaaat

SEQ ID NO: 247865 - DNA, 24 bp, Artificial sequence
  SiRNA target sequence
aatggcggtgattgtggaaaaatt

SEQ ID NO: 247866 - DNA, 24 bp, Artificial sequence
  SiRNA target sequence
atggcggtgattgtggaaaaatta

SEQ ID NO: 247867 - DNA, 24 bp, Artificial sequence
  SiRNA target sequence
tggcggtgattgtggaaaaattag

SEQ ID NO: 247868 - DNA, 24 bp, Artificial sequence
  SiRNA target sequence
ggcggtgattgtggaaaaattagg

SEQ ID NO: 247869 - DNA, 24 bp, Artificial sequence
  SiRNA target sequence
gcggtgattgtggaaaaattagga

SEQ ID NO: 247870 - DNA, 24 bp, Artificial sequence
  SiRNA target sequence
cggtgattgtggaaaaattaggaa

SEQ ID NO: 247871 - DNA, 24 bp, Artificial sequence
  SiRNA target sequence
ggtgattgtggaaaaattaggaac

SEQ ID NO: 247872 - DNA, 24 bp, Artificial sequence
  SiRNA target sequence
gtgattgtggaaaaattaggaaca

SEQ ID NO: 247873 - DNA, 24 bp, Artificial sequence
  SiRNA target sequence
tgattgtggaaaaattaggaacaa

SEQ ID NO: 247874 - DNA, 24 bp, Artificial sequence
  SiRNA target sequence
gattgtggaaaaattaggaacaat

SEQ ID NO: 247875 - DNA, 24 bp, Artificial sequence
  SiRNA target sequence
attgtggaaaaattaggaacaatt

SEQ ID NO: 247876 - DNA, 24 bp, Artificial sequence
  SiRNA target sequence
ttgtggaaaaattaggaacaattt

SEQ ID NO: 247877 - DNA, 24 bp, Artificial sequence
  SiRNA target sequence
tgtggaaaaattaggaacaatttc

SEQ ID NO: 247878 - DNA, 24 bp, Artificial sequence
  SiRNA target sequence
gtggaaaaattaggaacaatttct

SEQ ID NO: 247879 - DNA, 24 bp, Artificial sequence
  SiRNA target sequence
tggaaaaattaggaacaatttctt

SEQ ID NO: 247880 - DNA, 24 bp, Artificial sequence
  SiRNA target sequence
ggaaaaattaggaacaatttcttt

SEQ ID NO: 247881 - DNA, 24 bp, Artificial sequence
  SiRNA target sequence
gaaaaattaggaacaatttctttc

SEQ ID NO: 247882 - DNA, 24 bp, Artificial sequence
  SiRNA target sequence
aaaaattaggaacaatttctttca

SEQ ID NO: 247883 - DNA, 24 bp, Artificial sequence
  SiRNA target sequence
aaaattaggaacaatttctttcat

SEQ ID NO: 247884 - DNA, 24 bp, Artificial sequence
  SiRNA target sequence
aaattaggaacaatttctttcatt

SEQ ID NO: 247885 - DNA, 24 bp, Artificial sequence
  SiRNA target sequence
aattaggaacaatttctttcattt

SEQ ID NO: 247886 - DNA, 24 bp, Artificial sequence
  SiRNA target sequence
attaggaacaatttctttcatttc

SEQ ID NO: 247887 - DNA, 24 bp, Artificial sequence
  SiRNA target sequence
ttaggaacaatttctttcatttca

SEQ ID NO: 247888 - DNA, 24 bp, Artificial sequence
  SiRNA target sequence
taggaacaatttctttcatttcat

SEQ ID NO: 247889 - DNA, 24 bp, Artificial sequence
  SiRNA target sequence
aggaacaatttctttcatttcatc

SEQ ID NO: 247890 - DNA, 24 bp, Artificial sequence
  SiRNA target sequence
ggaacaatttctttcatttcatct

SEQ ID NO: 247891 - DNA, 24 bp, Artificial sequence
  SiRNA target sequence
gaacaatttctttcatttcatctt

SEQ ID NO: 247892 - DNA, 24 bp, Artificial sequence
  SiRNA target sequence
aacaatttctttcatttcatcttc

SEQ ID NO: 247893 - DNA, 24 bp, Artificial sequence
  SiRNA target sequence
acaatttctttcatttcatcttct

SEQ ID NO: 247894 - DNA, 24 bp, Artificial sequence
  SiRNA target sequence
caatttctttcatttcatcttctg

SEQ ID NO: 247895 - DNA, 24 bp, Artificial sequence
  SiRNA target sequence
aatttctttcatttcatcttctgt

SEQ ID NO: 247896 - DNA, 24 bp, Artificial sequence
  SiRNA target sequence
atttctttcatttcatcttctgta

SEQ ID NO: 247897 - DNA, 24 bp, Artificial sequence
  SiRNA target sequence
tttctttcatttcatcttctgtac

SEQ ID NO: 247898 - DNA, 24 bp, Artificial sequence
  SiRNA target sequence
ttctttcatttcatcttctgtaca

SEQ ID NO: 247899 - DNA, 24 bp, Artificial sequence
  SiRNA target sequence
tctttcatttcatcttctgtacaa

SEQ ID NO: 247900 - DNA, 24 bp, Artificial sequence
  SiRNA target sequence
ctttcatttcatcttctgtacaag

SEQ ID NO: 247901 - DNA, 24 bp, Artificial sequence
  SiRNA target sequence
tttcatttcatcttctgtacaagc

SEQ ID NO: 247902 - DNA, 24 bp, Artificial sequence
  SiRNA target sequence
ttcatttcatcttctgtacaagca

SEQ ID NO: 247903 - DNA, 24 bp, Artificial sequence
  SiRNA target sequence
tcatttcatcttctgtacaagcat

SEQ ID NO: 247904 - DNA, 24 bp, Artificial sequence
  SiRNA target sequence
catttcatcttctgtacaagcatg

SEQ ID NO: 247905 - DNA, 24 bp, Artificial sequence
  SiRNA target sequence
atttcatcttctgtacaagcatga

SEQ ID NO: 247906 - DNA, 24 bp, Artificial sequence
  SiRNA target sequence
tttcatcttctgtacaagcatgat

SEQ ID NO: 247907 - DNA, 24 bp, Artificial sequence
  SiRNA target sequence
ttcatcttctgtacaagcatgatt

SEQ ID NO: 247908 - DNA, 24 bp, Artificial sequence
  SiRNA target sequence
tcatcttctgtacaagcatgattg

SEQ ID NO: 247909 - DNA, 24 bp, Artificial sequence
  SiRNA target sequence
catcttctgtacaagcatgattgg

SEQ ID NO: 247910 - DNA, 24 bp, Artificial sequence
  SiRNA target sequence
atcttctgtacaagcatgattggc

SEQ ID NO: 247911 - DNA, 24 bp, Artificial sequence
  SiRNA target sequence
tcttctgtacaagcatgattggct

SEQ ID NO: 247912 - DNA, 24 bp, Artificial sequence
  SiRNA target sequence
cttctgtacaagcatgattggcta

SEQ ID NO: 247913 - DNA, 24 bp, Artificial sequence
  SiRNA target sequence
ttctgtacaagcatgattggctaa

SEQ ID NO: 247914 - DNA, 24 bp, Artificial sequence
  SiRNA target sequence
tctgtacaagcatgattggctaac

SEQ ID NO: 247915 - DNA, 24 bp, Artificial sequence
  SiRNA target sequence
ctgtacaagcatgattggctaacg

SEQ ID NO: 247916 - DNA, 24 bp, Artificial sequence
  SiRNA target sequence
tgtacaagcatgattggctaacgc

SEQ ID NO: 247917 - DNA, 24 bp, Artificial sequence
  SiRNA target sequence
gtacaagcatgattggctaacgca

SEQ ID NO: 247918 - DNA, 24 bp, Artificial sequence
  SiRNA target sequence
tacaagcatgattggctaacgcat

SEQ ID NO: 247919 - DNA, 24 bp, Artificial sequence
  SiRNA target sequence
acaagcatgattggctaacgcata

SEQ ID NO: 247920 - DNA, 24 bp, Artificial sequence
  SiRNA target sequence
caagcatgattggctaacgcatat

SEQ ID NO: 247921 - DNA, 24 bp, Artificial sequence
  SiRNA target sequence
aagcatgattggctaacgcatata

SEQ ID NO: 247922 - DNA, 24 bp, Artificial sequence
  SiRNA target sequence
agcatgattggctaacgcatataa

SEQ ID NO: 247923 - DNA, 24 bp, Artificial sequence
  SiRNA target sequence
gcatgattggctaacgcatataaa

SEQ ID NO: 247924 - DNA, 24 bp, Artificial sequence
  SiRNA target sequence
catgattggctaacgcatataaag

SEQ ID NO: 247925 - DNA, 24 bp, Artificial sequence
  SiRNA target sequence
atgattggctaacgcatataaagc

SEQ ID NO: 247926 - DNA, 24 bp, Artificial sequence
  SiRNA target sequence
tgattggctaacgcatataaagca

SEQ ID NO: 247927 - DNA, 24 bp, Artificial sequence
  SiRNA target sequence
gattggctaacgcatataaagcaa

SEQ ID NO: 247928 - DNA, 24 bp, Artificial sequence
  SiRNA target sequence
attggctaacgcatataaagcaaa

SEQ ID NO: 247929 - DNA, 24 bp, Artificial sequence
  SiRNA target sequence
ttggctaacgcatataaagcaaaa

SEQ ID NO: 247930 - DNA, 24 bp, Artificial sequence
  SiRNA target sequence
tggctaacgcatataaagcaaaac

SEQ ID NO: 247931 - DNA, 24 bp, Artificial sequence
  SiRNA target sequence
ggctaacgcatataaagcaaaacc

SEQ ID NO: 247932 - DNA, 24 bp, Artificial sequence
  SiRNA target sequence
gctaacgcatataaagcaaaacca

SEQ ID NO: 247933 - DNA, 24 bp, Artificial sequence
  SiRNA target sequence
ctaacgcatataaagcaaaaccaa

SEQ ID NO: 247934 - DNA, 24 bp, Artificial sequence
  SiRNA target sequence
taacgcatataaagcaaaaccaac

SEQ ID NO: 247935 - DNA, 24 bp, Artificial sequence
  SiRNA target sequence
aacgcatataaagcaaaaccaact

SEQ ID NO: 247936 - DNA, 24 bp, Artificial sequence
  SiRNA target sequence
acgcatataaagcaaaaccaacta

SEQ ID NO: 247937 - DNA, 24 bp, Artificial sequence
  SiRNA target sequence
cgcatataaagcaaaaccaactac

SEQ ID NO: 247938 - DNA, 24 bp, Artificial sequence
  SiRNA target sequence
gcatataaagcaaaaccaactact

SEQ ID NO: 247939 - DNA, 24 bp, Artificial sequence
  SiRNA target sequence
catataaagcaaaaccaactacta

SEQ ID NO: 247940 - DNA, 24 bp, Artificial sequence
  SiRNA target sequence
atataaagcaaaaccaactactag

SEQ ID NO: 247941 - DNA, 24 bp, Artificial sequence
  SiRNA target sequence
tataaagcaaaaccaactactaga

SEQ ID NO: 247942 - DNA, 24 bp, Artificial sequence
  SiRNA target sequence
ataaagcaaaaccaactactagag

SEQ ID NO: 247943 - DNA, 24 bp, Artificial sequence
  SiRNA target sequence
taaagcaaaaccaactactagagt

SEQ ID NO: 247944 - DNA, 24 bp, Artificial sequence
  SiRNA target sequence
aaagcaaaaccaactactagagta

SEQ ID NO: 247945 - DNA, 24 bp, Artificial sequence
  SiRNA target sequence
aagcaaaaccaactactagagtac

SEQ ID NO: 247946 - DNA, 24 bp, Artificial sequence
  SiRNA target sequence
agcaaaaccaactactagagtact

SEQ ID NO: 247947 - DNA, 24 bp, Artificial sequence
  SiRNA target sequence
gcaaaaccaactactagagtactc

SEQ ID NO: 247948 - DNA, 24 bp, Artificial sequence
  SiRNA target sequence
caaaaccaactactagagtactcc

SEQ ID NO: 247949 - DNA, 24 bp, Artificial sequence
  SiRNA target sequence
aaaaccaactactagagtactcca

SEQ ID NO: 247950 - DNA, 24 bp, Artificial sequence
  SiRNA target sequence
aaaccaactactagagtactccac

SEQ ID NO: 247951 - DNA, 24 bp, Artificial sequence
  SiRNA target sequence
aaccaactactagagtactccaca

SEQ ID NO: 247952 - DNA, 24 bp, Artificial sequence
  SiRNA target sequence
accaactactagagtactccacaa

SEQ ID NO: 247953 - DNA, 24 bp, Artificial sequence
  SiRNA target sequence
ccaactactagagtactccacaac

SEQ ID NO: 247954 - DNA, 24 bp, Artificial sequence
  SiRNA target sequence
caactactagagtactccacaact

SEQ ID NO: 247955 - DNA, 24 bp, Artificial sequence
  SiRNA target sequence
aactactagagtactccacaactc

SEQ ID NO: 247956 - DNA, 24 bp, Artificial sequence
  SiRNA target sequence
actactagagtactccacaactcc

SEQ ID NO: 247957 - DNA, 24 bp, Artificial sequence
  SiRNA target sequence
ctactagagtactccacaactccg

SEQ ID NO: 247958 - DNA, 24 bp, Artificial sequence
  SiRNA target sequence
tactagagtactccacaactccga

SEQ ID NO: 247959 - DNA, 24 bp, Artificial sequence
  SiRNA target sequence
actagagtactccacaactccgat

SEQ ID NO: 247960 - DNA, 24 bp, Artificial sequence
  SiRNA target sequence
ctagagtactccacaactccgata

SEQ ID NO: 247961 - DNA, 24 bp, Artificial sequence
  SiRNA target sequence
tagagtactccacaactccgataa

SEQ ID NO: 247962 - DNA, 24 bp, Artificial sequence
  SiRNA target sequence
agagtactccacaactccgataag

SEQ ID NO: 247963 - DNA, 24 bp, Artificial sequence
  SiRNA target sequence
gagtactccacaactccgataaga

SEQ ID NO: 247964 - DNA, 24 bp, Artificial sequence
  SiRNA target sequence
agtactccacaactccgataagat

SEQ ID NO: 247965 - DNA, 24 bp, Artificial sequence
  SiRNA target sequence
gtactccacaactccgataagatg

SEQ ID NO: 247966 - DNA, 24 bp, Artificial sequence
  SiRNA target sequence
tactccacaactccgataagatgt

SEQ ID NO: 247967 - DNA, 24 bp, Artificial sequence
  SiRNA target sequence
actccacaactccgataagatgta

SEQ ID NO: 247968 - DNA, 24 bp, Artificial sequence
  SiRNA target sequence
ctccacaactccgataagatgtaa

SEQ ID NO: 247969 - DNA, 24 bp, Artificial sequence
  SiRNA target sequence
tccacaactccgataagatgtaac

SEQ ID NO: 247970 - DNA, 24 bp, Artificial sequence
  SiRNA target sequence
ccacaactccgataagatgtaaca

SEQ ID NO: 247971 - DNA, 24 bp, Artificial sequence
  SiRNA target sequence
cacaactccgataagatgtaacat

SEQ ID NO: 247972 - DNA, 24 bp, Artificial sequence
  SiRNA target sequence
acaactccgataagatgtaacata

SEQ ID NO: 247973 - DNA, 24 bp, Artificial sequence
  SiRNA target sequence
caactccgataagatgtaacataa

SEQ ID NO: 247974 - DNA, 24 bp, Artificial sequence
  SiRNA target sequence
aactccgataagatgtaacataaa

SEQ ID NO: 247975 - DNA, 24 bp, Artificial sequence
  SiRNA target sequence
actccgataagatgtaacataaag

SEQ ID NO: 247976 - DNA, 24 bp, Artificial sequence
  SiRNA target sequence
ctccgataagatgtaacataaagt

SEQ ID NO: 247977 - DNA, 24 bp, Artificial sequence
  SiRNA target sequence
tccgataagatgtaacataaagta

SEQ ID NO: 247978 - DNA, 24 bp, Artificial sequence
  SiRNA target sequence
ccgataagatgtaacataaagtac

SEQ ID NO: 247979 - DNA, 24 bp, Artificial sequence
  SiRNA target sequence
cgataagatgtaacataaagtact

SEQ ID NO: 247980 - DNA, 24 bp, Artificial sequence
  SiRNA target sequence
gataagatgtaacataaagtactt

SEQ ID NO: 247981 - DNA, 24 bp, Artificial sequence
  SiRNA target sequence
ataagatgtaacataaagtactta

SEQ ID NO: 247982 - DNA, 24 bp, Artificial sequence
  SiRNA target sequence
taagatgtaacataaagtacttat

SEQ ID NO: 247983 - DNA, 24 bp, Artificial sequence
  SiRNA target sequence
aagatgtaacataaagtacttatc

SEQ ID NO: 247984 - DNA, 24 bp, Artificial sequence
  SiRNA target sequence
agatgtaacataaagtacttatcc

SEQ ID NO: 247985 - DNA, 24 bp, Artificial sequence
  SiRNA target sequence
gatgtaacataaagtacttatcca

SEQ ID NO: 247986 - DNA, 24 bp, Artificial sequence
  SiRNA target sequence
atgtaacataaagtacttatccac

SEQ ID NO: 247987 - DNA, 24 bp, Artificial sequence
  SiRNA target sequence
tgtaacataaagtacttatccact

SEQ ID NO: 247988 - DNA, 24 bp, Artificial sequence
  SiRNA target sequence
gtaacataaagtacttatccactc

SEQ ID NO: 247989 - DNA, 24 bp, Artificial sequence
  SiRNA target sequence
taacataaagtacttatccactca

SEQ ID NO: 247990 - DNA, 24 bp, Artificial sequence
  SiRNA target sequence
aacataaagtacttatccactcac

SEQ ID NO: 247991 - DNA, 24 bp, Artificial sequence
  SiRNA target sequence
acataaagtacttatccactcact

SEQ ID NO: 247992 - DNA, 24 bp, Artificial sequence
  SiRNA target sequence
cataaagtacttatccactcactg

SEQ ID NO: 247993 - DNA, 24 bp, Artificial sequence
  SiRNA target sequence
ataaagtacttatccactcactgt

SEQ ID NO: 247994 - DNA, 24 bp, Artificial sequence
  SiRNA target sequence
taaagtacttatccactcactgta

SEQ ID NO: 247995 - DNA, 24 bp, Artificial sequence
  SiRNA target sequence
aaagtacttatccactcactgtac

SEQ ID NO: 247996 - DNA, 24 bp, Artificial sequence
  SiRNA target sequence
aagtacttatccactcactgtaca

SEQ ID NO: 247997 - DNA, 24 bp, Artificial sequence
  SiRNA target sequence
agtacttatccactcactgtacat

SEQ ID NO: 247998 - DNA, 24 bp, Artificial sequence
  SiRNA target sequence
gtacttatccactcactgtacata

SEQ ID NO: 247999 - DNA, 24 bp, Artificial sequence
  SiRNA target sequence
tacttatccactcactgtacatat

SEQ ID NO: 248000 - DNA, 24 bp, Artificial sequence
  SiRNA target sequence
acttatccactcactgtacatata

SEQ ID NO: 248001 - DNA, 24 bp, Artificial sequence
  SiRNA target sequence
cttatccactcactgtacatatat

SEQ ID NO: 248002 - DNA, 24 bp, Artificial sequence
  SiRNA target sequence
ttatccactcactgtacatatata

SEQ ID NO: 248003 - DNA, 24 bp, Artificial sequence
  SiRNA target sequence
tatccactcactgtacatatataa

SEQ ID NO: 248004 - DNA, 24 bp, Artificial sequence
  SiRNA target sequence
atccactcactgtacatatataaa

SEQ ID NO: 248005 - DNA, 24 bp, Artificial sequence
  SiRNA target sequence
tccactcactgtacatatataaaa

SEQ ID NO: 248006 - DNA, 24 bp, Artificial sequence
  SiRNA target sequence
ccactcactgtacatatataaaaa

SEQ ID NO: 248007 - DNA, 24 bp, Artificial sequence
  SiRNA target sequence
cactcactgtacatatataaaaaa

SEQ ID NO: 248008 - DNA, 24 bp, Artificial sequence
  SiRNA target sequence
actcactgtacatatataaaaaag

SEQ ID NO: 248009 - DNA, 24 bp, Artificial sequence
  SiRNA target sequence
ctcactgtacatatataaaaaagg

SEQ ID NO: 248010 - DNA, 24 bp, Artificial sequence
  SiRNA target sequence
tcactgtacatatataaaaaagga

SEQ ID NO: 248011 - DNA, 24 bp, Artificial sequence
  SiRNA target sequence
cactgtacatatataaaaaaggag

SEQ ID NO: 248012 - DNA, 24 bp, Artificial sequence
  SiRNA target sequence
actgtacatatataaaaaaggaga

SEQ ID NO: 248013 - DNA, 24 bp, Artificial sequence
  SiRNA target sequence
ctgtacatatataaaaaaggagat

SEQ ID NO: 248014 - DNA, 24 bp, Artificial sequence
  SiRNA target sequence
tgtacatatataaaaaaggagata

SEQ ID NO: 248015 - DNA, 24 bp, Artificial sequence
  SiRNA target sequence
gtacatatataaaaaaggagataa

SEQ ID NO: 248016 - DNA, 24 bp, Artificial sequence
  SiRNA target sequence
tacatatataaaaaaggagataag

SEQ ID NO: 248017 - DNA, 24 bp, Artificial sequence
  SiRNA target sequence
acatatataaaaaaggagataagc

SEQ ID NO: 248018 - DNA, 24 bp, Artificial sequence
  SiRNA target sequence
catatataaaaaaggagataagcc

SEQ ID NO: 248019 - DNA, 24 bp, Artificial sequence
  SiRNA target sequence
atatataaaaaaggagataagccc

SEQ ID NO: 248020 - DNA, 24 bp, Artificial sequence
  SiRNA target sequence
tatataaaaaaggagataagccca

SEQ ID NO: 248021 - DNA, 24 bp, Artificial sequence
  SiRNA target sequence
atataaaaaaggagataagcccat

SEQ ID NO: 248022 - DNA, 24 bp, Artificial sequence
  SiRNA target sequence
tataaaaaaggagataagcccatc

SEQ ID NO: 248023 - DNA, 24 bp, Artificial sequence
  SiRNA target sequence
ataaaaaaggagataagcccatca

SEQ ID NO: 248024 - DNA, 24 bp, Artificial sequence
  SiRNA target sequence
taaaaaaggagataagcccatcaa

SEQ ID NO: 248025 - DNA, 24 bp, Artificial sequence
  SiRNA target sequence
aaaaaaggagataagcccatcaag

SEQ ID NO: 248026 - DNA, 24 bp, Artificial sequence
  SiRNA target sequence
aaaaaggagataagcccatcaagc

SEQ ID NO: 248027 - DNA, 24 bp, Artificial sequence
  SiRNA target sequence
aaaaggagataagcccatcaagct

SEQ ID NO: 248028 - DNA, 24 bp, Artificial sequence
  SiRNA target sequence
aaaggagataagcccatcaagctt

SEQ ID NO: 248029 - DNA, 24 bp, Artificial sequence
  SiRNA target sequence
aaggagataagcccatcaagcttc

SEQ ID NO: 248030 - DNA, 24 bp, Artificial sequence
  SiRNA target sequence
aggagataagcccatcaagcttct

SEQ ID NO: 248031 - DNA, 24 bp, Artificial sequence
  SiRNA target sequence
ggagataagcccatcaagcttcta

SEQ ID NO: 248032 - DNA, 24 bp, Artificial sequence
  SiRNA target sequence
gagataagcccatcaagcttctaa

SEQ ID NO: 248033 - DNA, 24 bp, Artificial sequence
  SiRNA target sequence
agataagcccatcaagcttctaac

SEQ ID NO: 248034 - DNA, 24 bp, Artificial sequence
  SiRNA target sequence
gataagcccatcaagcttctaact

SEQ ID NO: 248035 - DNA, 24 bp, Artificial sequence
  SiRNA target sequence
ataagcccatcaagcttctaactg

SEQ ID NO: 248036 - DNA, 24 bp, Artificial sequence
  SiRNA target sequence
taagcccatcaagcttctaactga

SEQ ID NO: 248037 - DNA, 24 bp, Artificial sequence
  SiRNA target sequence
aagcccatcaagcttctaactgac

SEQ ID NO: 248038 - DNA, 24 bp, Artificial sequence
  SiRNA target sequence
agcccatcaagcttctaactgaca

SEQ ID NO: 248039 - DNA, 24 bp, Artificial sequence
  SiRNA target sequence
gcccatcaagcttctaactgacat

SEQ ID NO: 248040 - DNA, 24 bp, Artificial sequence
  SiRNA target sequence
cccatcaagcttctaactgacatc

SEQ ID NO: 248041 - DNA, 24 bp, Artificial sequence
  SiRNA target sequence
ccatcaagcttctaactgacatct

SEQ ID NO: 248042 - DNA, 24 bp, Artificial sequence
  SiRNA target sequence
catcaagcttctaactgacatctt

SEQ ID NO: 248043 - DNA, 24 bp, Artificial sequence
  SiRNA target sequence
atcaagcttctaactgacatctta

SEQ ID NO: 248044 - DNA, 24 bp, Artificial sequence
  SiRNA target sequence
tcaagcttctaactgacatcttac

SEQ ID NO: 248045 - DNA, 24 bp, Artificial sequence
  SiRNA target sequence
caagcttctaactgacatcttacc

SEQ ID NO: 248046 - DNA, 24 bp, Artificial sequence
  SiRNA target sequence
aagcttctaactgacatcttacca

SEQ ID NO: 248047 - DNA, 24 bp, Artificial sequence
  SiRNA target sequence
agcttctaactgacatcttaccat

SEQ ID NO: 248048 - DNA, 24 bp, Artificial sequence
  SiRNA target sequence
gcttctaactgacatcttaccatc

SEQ ID NO: 248049 - DNA, 24 bp, Artificial sequence
  SiRNA target sequence
cttctaactgacatcttaccatca

SEQ ID NO: 248050 - DNA, 24 bp, Artificial sequence
  SiRNA target sequence
ttctaactgacatcttaccatcac

SEQ ID NO: 248051 - DNA, 24 bp, Artificial sequence
  SiRNA target sequence
tctaactgacatcttaccatcaca

SEQ ID NO: 248052 - DNA, 24 bp, Artificial sequence
  SiRNA target sequence
ctaactgacatcttaccatcacaa

SEQ ID NO: 248053 - DNA, 24 bp, Artificial sequence
  SiRNA target sequence
taactgacatcttaccatcacaaa

SEQ ID NO: 248054 - DNA, 24 bp, Artificial sequence
  SiRNA target sequence
aactgacatcttaccatcacaaaa

SEQ ID NO: 248055 - DNA, 24 bp, Artificial sequence
  SiRNA target sequence
actgacatcttaccatcacaaaaa

SEQ ID NO: 248056 - DNA, 24 bp, Artificial sequence
  SiRNA target sequence
ctgacatcttaccatcacaaaaaa

SEQ ID NO: 248057 - DNA, 24 bp, Artificial sequence
  SiRNA target sequence
tgacatcttaccatcacaaaaaat

SEQ ID NO: 248058 - DNA, 24 bp, Artificial sequence
  SiRNA target sequence
gacatcttaccatcacaaaaaata

SEQ ID NO: 248059 - DNA, 24 bp, Artificial sequence
  SiRNA target sequence
acatcttaccatcacaaaaaatat

SEQ ID NO: 248060 - DNA, 24 bp, Artificial sequence
  SiRNA target sequence
catcttaccatcacaaaaaatatc

SEQ ID NO: 248061 - DNA, 24 bp, Artificial sequence
  SiRNA target sequence
atcttaccatcacaaaaaatatct

SEQ ID NO: 248062 - DNA, 24 bp, Artificial sequence
  SiRNA target sequence
tcttaccatcacaaaaaatatcta

SEQ ID NO: 248063 - DNA, 24 bp, Artificial sequence
  SiRNA target sequence
cttaccatcacaaaaaatatctag

SEQ ID NO: 248064 - DNA, 24 bp, Artificial sequence
  SiRNA target sequence
ttaccatcacaaaaaatatctagt

SEQ ID NO: 248065 - DNA, 24 bp, Artificial sequence
  SiRNA target sequence
taccatcacaaaaaatatctagtg

SEQ ID NO: 248066 - DNA, 24 bp, Artificial sequence
  SiRNA target sequence
accatcacaaaaaatatctagtgc

SEQ ID NO: 248067 - DNA, 24 bp, Artificial sequence
  SiRNA target sequence
ccatcacaaaaaatatctagtgcc

SEQ ID NO: 248068 - DNA, 24 bp, Artificial sequence
  SiRNA target sequence
catcacaaaaaatatctagtgccc

SEQ ID NO: 248069 - DNA, 24 bp, Artificial sequence
  SiRNA target sequence
atcacaaaaaatatctagtgccca

SEQ ID NO: 248070 - DNA, 24 bp, Artificial sequence
  SiRNA target sequence
tcacaaaaaatatctagtgcccat

SEQ ID NO: 248071 - DNA, 24 bp, Artificial sequence
  SiRNA target sequence
cacaaaaaatatctagtgcccatt

SEQ ID NO: 248072 - DNA, 24 bp, Artificial sequence
  SiRNA target sequence
acaaaaaatatctagtgcccattg

SEQ ID NO: 248073 - DNA, 24 bp, Artificial sequence
  SiRNA target sequence
caaaaaatatctagtgcccattgt

SEQ ID NO: 248074 - DNA, 24 bp, Artificial sequence
  SiRNA target sequence
aaaaaatatctagtgcccattgtg

SEQ ID NO: 248075 - DNA, 24 bp, Artificial sequence
  SiRNA target sequence
aaaaatatctagtgcccattgtga

SEQ ID NO: 248076 - DNA, 24 bp, Artificial sequence
  SiRNA target sequence
aaaatatctagtgcccattgtgat

SEQ ID NO: 248077 - DNA, 24 bp, Artificial sequence
  SiRNA target sequence
aaatatctagtgcccattgtgatc

SEQ ID NO: 248078 - DNA, 24 bp, Artificial sequence
  SiRNA target sequence
aatatctagtgcccattgtgatcc

SEQ ID NO: 248079 - DNA, 24 bp, Artificial sequence
  SiRNA target sequence
atatctagtgcccattgtgatcct

SEQ ID NO: 248080 - DNA, 24 bp, Artificial sequence
  SiRNA target sequence
tatctagtgcccattgtgatcctt

SEQ ID NO: 248081 - DNA, 24 bp, Artificial sequence
  SiRNA target sequence
atctagtgcccattgtgatccttt

SEQ ID NO: 248082 - DNA, 24 bp, Artificial sequence
  SiRNA target sequence
tctagtgcccattgtgatcctttt

SEQ ID NO: 248083 - DNA, 24 bp, Artificial sequence
  SiRNA target sequence
ctagtgcccattgtgatccttttt

SEQ ID NO: 248084 - DNA, 24 bp, Artificial sequence
  SiRNA target sequence
tagtgcccattgtgatcctttttg

SEQ ID NO: 248085 - DNA, 24 bp, Artificial sequence
  SiRNA target sequence
agtgcccattgtgatcctttttgg

SEQ ID NO: 248086 - DNA, 24 bp, Artificial sequence
  SiRNA target sequence
gtgcccattgtgatcctttttgga

SEQ ID NO: 248087 - DNA, 24 bp, Artificial sequence
  SiRNA target sequence
tgcccattgtgatcctttttggat

SEQ ID NO: 248088 - DNA, 24 bp, Artificial sequence
  SiRNA target sequence
gcccattgtgatcctttttggatt

SEQ ID NO: 248089 - DNA, 24 bp, Artificial sequence
  SiRNA target sequence
cccattgtgatcctttttggattt

SEQ ID NO: 248090 - DNA, 24 bp, Artificial sequence
  SiRNA target sequence
ccattgtgatcctttttggatttt

SEQ ID NO: 248091 - DNA, 24 bp, Artificial sequence
  SiRNA target sequence
cattgtgatcctttttggatttta

SEQ ID NO: 248092 - DNA, 24 bp, Artificial sequence
  SiRNA target sequence
attgtgatcctttttggattttat

SEQ ID NO: 248093 - DNA, 24 bp, Artificial sequence
  SiRNA target sequence
ttgtgatcctttttggattttata

SEQ ID NO: 248094 - DNA, 24 bp, Artificial sequence
  SiRNA target sequence
tgtgatcctttttggattttatat

SEQ ID NO: 248095 - DNA, 24 bp, Artificial sequence
  SiRNA target sequence
gtgatcctttttggattttatatt

SEQ ID NO: 248096 - DNA, 24 bp, Artificial sequence
  SiRNA target sequence
tgatcctttttggattttatattc

SEQ ID NO: 248097 - DNA, 24 bp, Artificial sequence
  SiRNA target sequence
gatcctttttggattttatattca

SEQ ID NO: 248098 - DNA, 24 bp, Artificial sequence
  SiRNA target sequence
atcctttttggattttatattcaa

SEQ ID NO: 248099 - DNA, 24 bp, Artificial sequence
  SiRNA target sequence
tcctttttggattttatattcaaa

SEQ ID NO: 248100 - DNA, 24 bp, Artificial sequence
  SiRNA target sequence
cctttttggattttatattcaaat

SEQ ID NO: 248101 - DNA, 24 bp, Artificial sequence
  SiRNA target sequence
ctttttggattttatattcaaatg

SEQ ID NO: 248102 - DNA, 24 bp, Artificial sequence
  SiRNA target sequence
tttttggattttatattcaaatgg

SEQ ID NO: 248103 - DNA, 24 bp, Artificial sequence
  SiRNA target sequence
ttttggattttatattcaaatgga

SEQ ID NO: 248104 - DNA, 24 bp, Artificial sequence
  SiRNA target sequence
tttggattttatattcaaatggaa

SEQ ID NO: 248105 - DNA, 24 bp, Artificial sequence
  SiRNA target sequence
ttggattttatattcaaatggaat

SEQ ID NO: 248106 - DNA, 24 bp, Artificial sequence
  SiRNA target sequence
tggattttatattcaaatggaatt

SEQ ID NO: 248107 - DNA, 24 bp, Artificial sequence
  SiRNA target sequence
ggattttatattcaaatggaatta

SEQ ID NO: 248108 - DNA, 24 bp, Artificial sequence
  SiRNA target sequence
gattttatattcaaatggaattaa

SEQ ID NO: 248109 - DNA, 24 bp, Artificial sequence
  SiRNA target sequence
attttatattcaaatggaattaaa

SEQ ID NO: 248110 - DNA, 24 bp, Artificial sequence
  SiRNA target sequence
ttttatattcaaatggaattaaaa

SEQ ID NO: 248111 - DNA, 24 bp, Artificial sequence
  SiRNA target sequence
tttatattcaaatggaattaaaag

SEQ ID NO: 248112 - DNA, 24 bp, Artificial sequence
  SiRNA target sequence
ttatattcaaatggaattaaaaga

SEQ ID NO: 248113 - DNA, 24 bp, Artificial sequence
  SiRNA target sequence
tatattcaaatggaattaaaagag

SEQ ID NO: 248114 - DNA, 24 bp, Artificial sequence
  SiRNA target sequence
atattcaaatggaattaaaagaga

SEQ ID NO: 248115 - DNA, 24 bp, Artificial sequence
  SiRNA target sequence
tattcaaatggaattaaaagagaa

SEQ ID NO: 248116 - DNA, 24 bp, Artificial sequence
  SiRNA target sequence
attcaaatggaattaaaagagaac

SEQ ID NO: 248117 - DNA, 24 bp, Artificial sequence
  SiRNA target sequence
ttcaaatggaattaaaagagaacc

SEQ ID NO: 248118 - DNA, 24 bp, Artificial sequence
  SiRNA target sequence
tcaaatggaattaaaagagaacca

SEQ ID NO: 248119 - DNA, 24 bp, Artificial sequence
  SiRNA target sequence
caaatggaattaaaagagaaccaa

SEQ ID NO: 248120 - DNA, 24 bp, Artificial sequence
  SiRNA target sequence
aaatggaattaaaagagaaccaat

SEQ ID NO: 248121 - DNA, 24 bp, Artificial sequence
  SiRNA target sequence
aatggaattaaaagagaaccaatt

SEQ ID NO: 248122 - DNA, 24 bp, Artificial sequence
  SiRNA target sequence
atggaattaaaagagaaccaatta

SEQ ID NO: 248123 - DNA, 24 bp, Artificial sequence
  SiRNA target sequence
tggaattaaaagagaaccaattag

SEQ ID NO: 248124 - DNA, 24 bp, Artificial sequence
  SiRNA target sequence
ggaattaaaagagaaccaattaga

SEQ ID NO: 248125 - DNA, 24 bp, Artificial sequence
  SiRNA target sequence
gaattaaaagagaaccaattagaa

SEQ ID NO: 248126 - DNA, 24 bp, Artificial sequence
  SiRNA target sequence
aattaaaagagaaccaattagaaa

SEQ ID NO: 248127 - DNA, 24 bp, Artificial sequence
  SiRNA target sequence
attaaaagagaaccaattagaaaa

SEQ ID NO: 248128 - DNA, 24 bp, Artificial sequence
  SiRNA target sequence
ttaaaagagaaccaattagaaaaa

SEQ ID NO: 248129 - DNA, 24 bp, Artificial sequence
  SiRNA target sequence
taaaagagaaccaattagaaaaaa

SEQ ID NO: 248130 - DNA, 24 bp, Artificial sequence
  SiRNA target sequence
aaaagagaaccaattagaaaaaaa

SEQ ID NO: 248131 - DNA, 24 bp, Artificial sequence
  SiRNA target sequence
aaagagaaccaattagaaaaaaaa

SEQ ID NO: 248132 - DNA, 24 bp, Artificial sequence
  SiRNA target sequence
aagagaaccaattagaaaaaaaat

SEQ ID NO: 248133 - DNA, 24 bp, Artificial sequence
  SiRNA target sequence
agagaaccaattagaaaaaaaatg

SEQ ID NO: 248134 - DNA, 24 bp, Artificial sequence
  SiRNA target sequence
gagaaccaattagaaaaaaaatgc

SEQ ID NO: 248135 - DNA, 24 bp, Artificial sequence
  SiRNA target sequence
agaaccaattagaaaaaaaatgcc

SEQ ID NO: 248136 - DNA, 24 bp, Artificial sequence
  SiRNA target sequence
gaaccaattagaaaaaaaatgcca

SEQ ID NO: 248137 - DNA, 24 bp, Artificial sequence
  SiRNA target sequence
aaccaattagaaaaaaaatgccaa

SEQ ID NO: 248138 - DNA, 24 bp, Artificial sequence
  SiRNA target sequence
accaattagaaaaaaaatgccaat

SEQ ID NO: 248139 - DNA, 24 bp, Artificial sequence
  SiRNA target sequence
ccaattagaaaaaaaatgccaata

SEQ ID NO: 248140 - DNA, 24 bp, Artificial sequence
  SiRNA target sequence
caattagaaaaaaaatgccaataa

SEQ ID NO: 248141 - DNA, 24 bp, Artificial sequence
  SiRNA target sequence
aattagaaaaaaaatgccaataaa

SEQ ID NO: 248142 - DNA, 24 bp, Artificial sequence
  SiRNA target sequence
attagaaaaaaaatgccaataaaa

SEQ ID NO: 248143 - DNA, 24 bp, Artificial sequence
  SiRNA target sequence
ttagaaaaaaaatgccaataaaac

SEQ ID NO: 248144 - DNA, 24 bp, Artificial sequence
  SiRNA target sequence
tagaaaaaaaatgccaataaaacc

SEQ ID NO: 248145 - DNA, 24 bp, Artificial sequence
  SiRNA target sequence
agaaaaaaaatgccaataaaacca

SEQ ID NO: 248146 - DNA, 24 bp, Artificial sequence
  SiRNA target sequence
gaaaaaaaatgccaataaaaccaa

SEQ ID NO: 248147 - DNA, 24 bp, Artificial sequence
  SiRNA target sequence
aaaaaaaatgccaataaaaccaaa

SEQ ID NO: 248148 - DNA, 24 bp, Artificial sequence
  SiRNA target sequence
aaaaaaatgccaataaaaccaaaa

SEQ ID NO: 248149 - DNA, 24 bp, Artificial sequence
  SiRNA target sequence
aaaaaatgccaataaaaccaaaaa

SEQ ID NO: 248150 - DNA, 24 bp, Artificial sequence
  SiRNA target sequence
aaaaatgccaataaaaccaaaaat

SEQ ID NO: 248151 - DNA, 24 bp, Artificial sequence
  SiRNA target sequence
aaaatgccaataaaaccaaaaata

SEQ ID NO: 248152 - DNA, 24 bp, Artificial sequence
  SiRNA target sequence
aaatgccaataaaaccaaaaataa

SEQ ID NO: 248153 - DNA, 24 bp, Artificial sequence
  SiRNA target sequence
aatgccaataaaaccaaaaataat

SEQ ID NO: 248154 - DNA, 24 bp, Artificial sequence
  SiRNA target sequence
atgccaataaaaccaaaaataata

SEQ ID NO: 248155 - DNA, 24 bp, Artificial sequence
  SiRNA target sequence
tgccaataaaaccaaaaataataa

SEQ ID NO: 248156 - DNA, 24 bp, Artificial sequence
  SiRNA target sequence
gccaataaaaccaaaaataataaa

SEQ ID NO: 248157 - DNA, 24 bp, Artificial sequence
  SiRNA target sequence
ccaataaaaccaaaaataataaaa

SEQ ID NO: 248158 - DNA, 24 bp, Artificial sequence
  SiRNA target sequence
caataaaaccaaaaataataaaat

SEQ ID NO: 248159 - DNA, 24 bp, Artificial sequence
  SiRNA target sequence
aataaaaccaaaaataataaaatt

SEQ ID NO: 248160 - DNA, 24 bp, Artificial sequence
  SiRNA target sequence
ataaaaccaaaaataataaaattc

SEQ ID NO: 248161 - DNA, 24 bp, Artificial sequence
  SiRNA target sequence
taaaaccaaaaataataaaattca

SEQ ID NO: 248162 - DNA, 24 bp, Artificial sequence
  SiRNA target sequence
aaaaccaaaaataataaaattcac

SEQ ID NO: 248163 - DNA, 24 bp, Artificial sequence
  SiRNA target sequence
aaaccaaaaataataaaattcaca

SEQ ID NO: 248164 - DNA, 24 bp, Artificial sequence
  SiRNA target sequence
aaccaaaaataataaaattcacaa

SEQ ID NO: 248165 - DNA, 24 bp, Artificial sequence
  SiRNA target sequence
accaaaaataataaaattcacaat

SEQ ID NO: 248166 - DNA, 24 bp, Artificial sequence
  SiRNA target sequence
ccaaaaataataaaattcacaata

SEQ ID NO: 248167 - DNA, 24 bp, Artificial sequence
  SiRNA target sequence
caaaaataataaaattcacaatac

SEQ ID NO: 248168 - DNA, 24 bp, Artificial sequence
  SiRNA target sequence
aaaaataataaaattcacaatact

SEQ ID NO: 248169 - DNA, 24 bp, Artificial sequence
  SiRNA target sequence
aaaataataaaattcacaatacta

SEQ ID NO: 248170 - DNA, 24 bp, Artificial sequence
  SiRNA target sequence
aaataataaaattcacaatactaa

SEQ ID NO: 248171 - DNA, 24 bp, Artificial sequence
  SiRNA target sequence
aataataaaattcacaatactaag

SEQ ID NO: 248172 - DNA, 24 bp, Artificial sequence
  SiRNA target sequence
ataataaaattcacaatactaaga

SEQ ID NO: 248173 - DNA, 24 bp, Artificial sequence
  SiRNA target sequence
taataaaattcacaatactaagaa

SEQ ID NO: 248174 - DNA, 24 bp, Artificial sequence
  SiRNA target sequence
aataaaattcacaatactaagaat

SEQ ID NO: 248175 - DNA, 24 bp, Artificial sequence
  SiRNA target sequence
ataaaattcacaatactaagaata

SEQ ID NO: 248176 - DNA, 24 bp, Artificial sequence
  SiRNA target sequence
taaaattcacaatactaagaatag

SEQ ID NO: 248177 - DNA, 24 bp, Artificial sequence
  SiRNA target sequence
aaaattcacaatactaagaataga

SEQ ID NO: 248178 - DNA, 24 bp, Artificial sequence
  SiRNA target sequence
aaattcacaatactaagaatagag

SEQ ID NO: 248179 - DNA, 24 bp, Artificial sequence
  SiRNA target sequence
aattcacaatactaagaatagagt

SEQ ID NO: 248180 - DNA, 24 bp, Artificial sequence
  SiRNA target sequence
attcacaatactaagaatagagta

SEQ ID NO: 248181 - DNA, 24 bp, Artificial sequence
  SiRNA target sequence
ttcacaatactaagaatagagtac

SEQ ID NO: 248182 - DNA, 24 bp, Artificial sequence
  SiRNA target sequence
tcacaatactaagaatagagtaca

SEQ ID NO: 248183 - DNA, 24 bp, Artificial sequence
  SiRNA target sequence
cacaatactaagaatagagtacac

SEQ ID NO: 248184 - DNA, 24 bp, Artificial sequence
  SiRNA target sequence
acaatactaagaatagagtacaca

SEQ ID NO: 248185 - DNA, 24 bp, Artificial sequence
  SiRNA target sequence
caatactaagaatagagtacacat

SEQ ID NO: 248186 - DNA, 24 bp, Artificial sequence
  SiRNA target sequence
aatactaagaatagagtacacatt

SEQ ID NO: 248187 - DNA, 24 bp, Artificial sequence
  SiRNA target sequence
atactaagaatagagtacacattt

SEQ ID NO: 248188 - DNA, 24 bp, Artificial sequence
  SiRNA target sequence
tactaagaatagagtacacattta

SEQ ID NO: 248189 - DNA, 24 bp, Artificial sequence
  SiRNA target sequence
actaagaatagagtacacatttaa

SEQ ID NO: 248190 - DNA, 24 bp, Artificial sequence
  SiRNA target sequence
ctaagaatagagtacacatttaaa

SEQ ID NO: 248191 - DNA, 24 bp, Artificial sequence
  SiRNA target sequence
taagaatagagtacacatttaaag

SEQ ID NO: 248192 - DNA, 24 bp, Artificial sequence
  SiRNA target sequence
aagaatagagtacacatttaaagc

SEQ ID NO: 248193 - DNA, 24 bp, Artificial sequence
  SiRNA target sequence
agaatagagtacacatttaaagcc

SEQ ID NO: 248194 - DNA, 24 bp, Artificial sequence
  SiRNA target sequence
gaatagagtacacatttaaagcct

SEQ ID NO: 248195 - DNA, 24 bp, Artificial sequence
  SiRNA target sequence
aatagagtacacatttaaagcctt

SEQ ID NO: 248196 - DNA, 24 bp, Artificial sequence
  SiRNA target sequence
atagagtacacatttaaagccttt

SEQ ID NO: 248197 - DNA, 24 bp, Artificial sequence
  SiRNA target sequence
tagagtacacatttaaagcctttt

SEQ ID NO: 248198 - DNA, 24 bp, Artificial sequence
  SiRNA target sequence
agagtacacatttaaagccttttg

SEQ ID NO: 248199 - DNA, 24 bp, Artificial sequence
  SiRNA target sequence
gagtacacatttaaagccttttgg

SEQ ID NO: 248200 - DNA, 24 bp, Artificial sequence
  SiRNA target sequence
agtacacatttaaagccttttgga

SEQ ID NO: 248201 - DNA, 24 bp, Artificial sequence
  SiRNA target sequence
gtacacatttaaagccttttggac

SEQ ID NO: 248202 - DNA, 24 bp, Artificial sequence
  SiRNA target sequence
tacacatttaaagccttttggaca

SEQ ID NO: 248203 - DNA, 24 bp, Artificial sequence
  SiRNA target sequence
acacatttaaagccttttggacat

SEQ ID NO: 248204 - DNA, 24 bp, Artificial sequence
  SiRNA target sequence
cacatttaaagccttttggacata

SEQ ID NO: 248205 - DNA, 24 bp, Artificial sequence
  SiRNA target sequence
acatttaaagccttttggacatat

SEQ ID NO: 248206 - DNA, 24 bp, Artificial sequence
  SiRNA target sequence
catttaaagccttttggacatatg

SEQ ID NO: 248207 - DNA, 24 bp, Artificial sequence
  SiRNA target sequence
atttaaagccttttggacatatga

SEQ ID NO: 248208 - DNA, 24 bp, Artificial sequence
  SiRNA target sequence
tttaaagccttttggacatatgac

SEQ ID NO: 248209 - DNA, 24 bp, Artificial sequence
  SiRNA target sequence
ttaaagccttttggacatatgaca

SEQ ID NO: 248210 - DNA, 24 bp, Artificial sequence
  SiRNA target sequence
taaagccttttggacatatgacat

SEQ ID NO: 248211 - DNA, 24 bp, Artificial sequence
  SiRNA target sequence
aaagccttttggacatatgacatc

SEQ ID NO: 248212 - DNA, 24 bp, Artificial sequence
  SiRNA target sequence
aagccttttggacatatgacatca

SEQ ID NO: 248213 - DNA, 24 bp, Artificial sequence
  SiRNA target sequence
agccttttggacatatgacatcat

SEQ ID NO: 248214 - DNA, 24 bp, Artificial sequence
  SiRNA target sequence
gccttttggacatatgacatcata

SEQ ID NO: 248215 - DNA, 24 bp, Artificial sequence
  SiRNA target sequence
ccttttggacatatgacatcataa

SEQ ID NO: 248216 - DNA, 24 bp, Artificial sequence
  SiRNA target sequence
cttttggacatatgacatcataag

SEQ ID NO: 248217 - DNA, 24 bp, Artificial sequence
  SiRNA target sequence
ttttggacatatgacatcataaga

SEQ ID NO: 248218 - DNA, 24 bp, Artificial sequence
  SiRNA target sequence
tttggacatatgacatcataagac

SEQ ID NO: 248219 - DNA, 24 bp, Artificial sequence
  SiRNA target sequence
ttggacatatgacatcataagaca

SEQ ID NO: 248220 - DNA, 24 bp, Artificial sequence
  SiRNA target sequence
tggacatatgacatcataagacat

SEQ ID NO: 248221 - DNA, 24 bp, Artificial sequence
  SiRNA target sequence
ggacatatgacatcataagacata

SEQ ID NO: 248222 - DNA, 24 bp, Artificial sequence
  SiRNA target sequence
gacatatgacatcataagacatat

SEQ ID NO: 248223 - DNA, 24 bp, Artificial sequence
  SiRNA target sequence
acatatgacatcataagacatata

SEQ ID NO: 248224 - DNA, 24 bp, Artificial sequence
  SiRNA target sequence
catatgacatcataagacatataa

SEQ ID NO: 248225 - DNA, 24 bp, Artificial sequence
  SiRNA target sequence
atatgacatcataagacatataat

SEQ ID NO: 248226 - DNA, 24 bp, Artificial sequence
  SiRNA target sequence
tatgacatcataagacatataatt

SEQ ID NO: 248227 - DNA, 24 bp, Artificial sequence
  SiRNA target sequence
atgacatcataagacatataattg

SEQ ID NO: 248228 - DNA, 24 bp, Artificial sequence
  SiRNA target sequence
tgacatcataagacatataattgg

SEQ ID NO: 248229 - DNA, 24 bp, Artificial sequence
  SiRNA target sequence
gacatcataagacatataattggc

SEQ ID NO: 248230 - DNA, 24 bp, Artificial sequence
  SiRNA target sequence
acatcataagacatataattggca

SEQ ID NO: 248231 - DNA, 24 bp, Artificial sequence
  SiRNA target sequence
catcataagacatataattggcag

SEQ ID NO: 248232 - DNA, 24 bp, Artificial sequence
  SiRNA target sequence
atcataagacatataattggcagt

SEQ ID NO: 248233 - DNA, 24 bp, Artificial sequence
  SiRNA target sequence
tcataagacatataattggcagtg

SEQ ID NO: 248234 - DNA, 24 bp, Artificial sequence
  SiRNA target sequence
cataagacatataattggcagtga

SEQ ID NO: 248235 - DNA, 24 bp, Artificial sequence
  SiRNA target sequence
ataagacatataattggcagtgaa

SEQ ID NO: 248236 - DNA, 24 bp, Artificial sequence
  SiRNA target sequence
taagacatataattggcagtgaaa

SEQ ID NO: 248237 - DNA, 24 bp, Artificial sequence
  SiRNA target sequence
aagacatataattggcagtgaaaa

SEQ ID NO: 248238 - DNA, 24 bp, Artificial sequence
  SiRNA target sequence
agacatataattggcagtgaaaag

SEQ ID NO: 248239 - DNA, 24 bp, Artificial sequence
  SiRNA target sequence
gacatataattggcagtgaaaaga

SEQ ID NO: 248240 - DNA, 24 bp, Artificial sequence
  SiRNA target sequence
acatataattggcagtgaaaagaa

SEQ ID NO: 248241 - DNA, 24 bp, Artificial sequence
  SiRNA target sequence
catataattggcagtgaaaagaaa

SEQ ID NO: 248242 - DNA, 24 bp, Artificial sequence
  SiRNA target sequence
atataattggcagtgaaaagaaaa

SEQ ID NO: 248243 - DNA, 24 bp, Artificial sequence
  SiRNA target sequence
tataattggcagtgaaaagaaaag

SEQ ID NO: 248244 - DNA, 24 bp, Artificial sequence
  SiRNA target sequence
ataattggcagtgaaaagaaaagc

SEQ ID NO: 248245 - DNA, 24 bp, Artificial sequence
  SiRNA target sequence
taattggcagtgaaaagaaaagct

SEQ ID NO: 248246 - DNA, 24 bp, Artificial sequence
  SiRNA target sequence
aattggcagtgaaaagaaaagctt

SEQ ID NO: 248247 - DNA, 24 bp, Artificial sequence
  SiRNA target sequence
attggcagtgaaaagaaaagcttt

SEQ ID NO: 248248 - DNA, 24 bp, Artificial sequence
  SiRNA target sequence
ttggcagtgaaaagaaaagcttta

SEQ ID NO: 248249 - DNA, 24 bp, Artificial sequence
  SiRNA target sequence
tggcagtgaaaagaaaagctttat

SEQ ID NO: 248250 - DNA, 24 bp, Artificial sequence
  SiRNA target sequence
ggcagtgaaaagaaaagctttatg

SEQ ID NO: 248251 - DNA, 24 bp, Artificial sequence
  SiRNA target sequence
gcagtgaaaagaaaagctttatgt

SEQ ID NO: 248252 - DNA, 24 bp, Artificial sequence
  SiRNA target sequence
cagtgaaaagaaaagctttatgta

SEQ ID NO: 248253 - DNA, 24 bp, Artificial sequence
  SiRNA target sequence
agtgaaaagaaaagctttatgtag

SEQ ID NO: 248254 - DNA, 24 bp, Artificial sequence
  SiRNA target sequence
gtgaaaagaaaagctttatgtagt

SEQ ID NO: 248255 - DNA, 24 bp, Artificial sequence
  SiRNA target sequence
tgaaaagaaaagctttatgtagta

SEQ ID NO: 248256 - DNA, 24 bp, Artificial sequence
  SiRNA target sequence
gaaaagaaaagctttatgtagtac

SEQ ID NO: 248257 - DNA, 24 bp, Artificial sequence
  SiRNA target sequence
aaaagaaaagctttatgtagtaca

SEQ ID NO: 248258 - DNA, 24 bp, Artificial sequence
  SiRNA target sequence
aaagaaaagctttatgtagtacag

SEQ ID NO: 248259 - DNA, 24 bp, Artificial sequence
  SiRNA target sequence
aagaaaagctttatgtagtacagt

SEQ ID NO: 248260 - DNA, 24 bp, Artificial sequence
  SiRNA target sequence
agaaaagctttatgtagtacagtg

SEQ ID NO: 248261 - DNA, 24 bp, Artificial sequence
  SiRNA target sequence
gaaaagctttatgtagtacagtga

SEQ ID NO: 248262 - DNA, 24 bp, Artificial sequence
  SiRNA target sequence
aaaagctttatgtagtacagtgac

SEQ ID NO: 248263 - DNA, 24 bp, Artificial sequence
  SiRNA target sequence
aaagctttatgtagtacagtgacg

SEQ ID NO: 248264 - DNA, 24 bp, Artificial sequence
  SiRNA target sequence
aagctttatgtagtacagtgacga

SEQ ID NO: 248265 - DNA, 24 bp, Artificial sequence
  SiRNA target sequence
agctttatgtagtacagtgacgaa

SEQ ID NO: 248266 - DNA, 24 bp, Artificial sequence
  SiRNA target sequence
gctttatgtagtacagtgacgaag

SEQ ID NO: 248267 - DNA, 24 bp, Artificial sequence
  SiRNA target sequence
ctttatgtagtacagtgacgaagg

SEQ ID NO: 248268 - DNA, 24 bp, Artificial sequence
  SiRNA target sequence
tttatgtagtacagtgacgaagga

SEQ ID NO: 248269 - DNA, 24 bp, Artificial sequence
  SiRNA target sequence
ttatgtagtacagtgacgaaggaa

SEQ ID NO: 248270 - DNA, 24 bp, Artificial sequence
  SiRNA target sequence
tatgtagtacagtgacgaaggaat

SEQ ID NO: 248271 - DNA, 24 bp, Artificial sequence
  SiRNA target sequence
atgtagtacagtgacgaaggaatt

SEQ ID NO: 248272 - DNA, 24 bp, Artificial sequence
  SiRNA target sequence
tgtagtacagtgacgaaggaattt

SEQ ID NO: 248273 - DNA, 24 bp, Artificial sequence
  SiRNA target sequence
gtagtacagtgacgaaggaatttg

SEQ ID NO: 248274 - DNA, 24 bp, Artificial sequence
  SiRNA target sequence
tagtacagtgacgaaggaatttgt

SEQ ID NO: 248275 - DNA, 24 bp, Artificial sequence
  SiRNA target sequence
agtacagtgacgaaggaatttgtt

SEQ ID NO: 248276 - DNA, 24 bp, Artificial sequence
  SiRNA target sequence
gtacagtgacgaaggaatttgttt

SEQ ID NO: 248277 - DNA, 24 bp, Artificial sequence
  SiRNA target sequence
tacagtgacgaaggaatttgtttt

SEQ ID NO: 248278 - DNA, 24 bp, Artificial sequence
  SiRNA target sequence
acagtgacgaaggaatttgttttg

SEQ ID NO: 248279 - DNA, 24 bp, Artificial sequence
  SiRNA target sequence
cagtgacgaaggaatttgttttgt

SEQ ID NO: 248280 - DNA, 24 bp, Artificial sequence
  SiRNA target sequence
agtgacgaaggaatttgttttgtc

SEQ ID NO: 248281 - DNA, 24 bp, Artificial sequence
  SiRNA target sequence
gtgacgaaggaatttgttttgtca

SEQ ID NO: 248282 - DNA, 24 bp, Artificial sequence
  SiRNA target sequence
tgacgaaggaatttgttttgtcat

SEQ ID NO: 248283 - DNA, 24 bp, Artificial sequence
  SiRNA target sequence
gacgaaggaatttgttttgtcata

SEQ ID NO: 248284 - DNA, 24 bp, Artificial sequence
  SiRNA target sequence
acgaaggaatttgttttgtcataa

SEQ ID NO: 248285 - DNA, 24 bp, Artificial sequence
  SiRNA target sequence
cgaaggaatttgttttgtcataat

SEQ ID NO: 248286 - DNA, 24 bp, Artificial sequence
  SiRNA target sequence
gaaggaatttgttttgtcataatc

SEQ ID NO: 248287 - DNA, 24 bp, Artificial sequence
  SiRNA target sequence
aaggaatttgttttgtcataatca

SEQ ID NO: 248288 - DNA, 24 bp, Artificial sequence
  SiRNA target sequence
aggaatttgttttgtcataatcac

SEQ ID NO: 248289 - DNA, 24 bp, Artificial sequence
  SiRNA target sequence
ggaatttgttttgtcataatcacg

SEQ ID NO: 248290 - DNA, 24 bp, Artificial sequence
  SiRNA target sequence
gaatttgttttgtcataatcacga

SEQ ID NO: 248291 - DNA, 24 bp, Artificial sequence
  SiRNA target sequence
aatttgttttgtcataatcacgat

SEQ ID NO: 248292 - DNA, 24 bp, Artificial sequence
  SiRNA target sequence
atttgttttgtcataatcacgatt

SEQ ID NO: 248293 - DNA, 24 bp, Artificial sequence
  SiRNA target sequence
tttgttttgtcataatcacgattt

SEQ ID NO: 248294 - DNA, 24 bp, Artificial sequence
  SiRNA target sequence
ttgttttgtcataatcacgatttc

SEQ ID NO: 248295 - DNA, 24 bp, Artificial sequence
  SiRNA target sequence
tgttttgtcataatcacgatttct

SEQ ID NO: 248296 - DNA, 24 bp, Artificial sequence
  SiRNA target sequence
gttttgtcataatcacgatttctc

SEQ ID NO: 248297 - DNA, 24 bp, Artificial sequence
  SiRNA target sequence
ttttgtcataatcacgatttctct

SEQ ID NO: 248298 - DNA, 24 bp, Artificial sequence
  SiRNA target sequence
tttgtcataatcacgatttctctg

SEQ ID NO: 248299 - DNA, 24 bp, Artificial sequence
  SiRNA target sequence
ttgtcataatcacgatttctctgt

SEQ ID NO: 248300 - DNA, 24 bp, Artificial sequence
  SiRNA target sequence
tgtcataatcacgatttctctgta

SEQ ID NO: 248301 - DNA, 24 bp, Artificial sequence
  SiRNA target sequence
gtcataatcacgatttctctgtaa

SEQ ID NO: 248302 - DNA, 24 bp, Artificial sequence
  SiRNA target sequence
tcataatcacgatttctctgtaaa

SEQ ID NO: 248303 - DNA, 24 bp, Artificial sequence
  SiRNA target sequence
cataatcacgatttctctgtaaaa

SEQ ID NO: 248304 - DNA, 24 bp, Artificial sequence
  SiRNA target sequence
ataatcacgatttctctgtaaaat

SEQ ID NO: 248305 - DNA, 24 bp, Artificial sequence
  SiRNA target sequence
taatcacgatttctctgtaaaatt

SEQ ID NO: 248306 - DNA, 24 bp, Artificial sequence
  SiRNA target sequence
aatcacgatttctctgtaaaattc

SEQ ID NO: 248307 - DNA, 24 bp, Artificial sequence
  SiRNA target sequence
atcacgatttctctgtaaaattcc

SEQ ID NO: 248308 - DNA, 24 bp, Artificial sequence
  SiRNA target sequence
tcacgatttctctgtaaaattcca

SEQ ID NO: 248309 - DNA, 24 bp, Artificial sequence
  SiRNA target sequence
cacgatttctctgtaaaattccaa

SEQ ID NO: 248310 - DNA, 24 bp, Artificial sequence
  SiRNA target sequence
acgatttctctgtaaaattccaat

SEQ ID NO: 248311 - DNA, 24 bp, Artificial sequence
  SiRNA target sequence
cgatttctctgtaaaattccaata

SEQ ID NO: 248312 - DNA, 24 bp, Artificial sequence
  SiRNA target sequence
gatttctctgtaaaattccaataa

SEQ ID NO: 248313 - DNA, 24 bp, Artificial sequence
  SiRNA target sequence
atttctctgtaaaattccaataat

SEQ ID NO: 248314 - DNA, 24 bp, Artificial sequence
  SiRNA target sequence
tttctctgtaaaattccaataatg

SEQ ID NO: 248315 - DNA, 24 bp, Artificial sequence
  SiRNA target sequence
ttctctgtaaaattccaataatgt

SEQ ID NO: 248316 - DNA, 24 bp, Artificial sequence
  SiRNA target sequence
tctctgtaaaattccaataatgtg

SEQ ID NO: 248317 - DNA, 24 bp, Artificial sequence
  SiRNA target sequence
ctctgtaaaattccaataatgtgt

SEQ ID NO: 248318 - DNA, 24 bp, Artificial sequence
  SiRNA target sequence
tctgtaaaattccaataatgtgtt

SEQ ID NO: 248319 - DNA, 24 bp, Artificial sequence
  SiRNA target sequence
ctgtaaaattccaataatgtgtta

SEQ ID NO: 248320 - DNA, 24 bp, Artificial sequence
  SiRNA target sequence
tgtaaaattccaataatgtgttaa

SEQ ID NO: 248321 - DNA, 24 bp, Artificial sequence
  SiRNA target sequence
gtaaaattccaataatgtgttaat

SEQ ID NO: 248322 - DNA, 24 bp, Artificial sequence
  SiRNA target sequence
taaaattccaataatgtgttaatc

SEQ ID NO: 248323 - DNA, 24 bp, Artificial sequence
  SiRNA target sequence
aaaattccaataatgtgttaatca

SEQ ID NO: 248324 - DNA, 24 bp, Artificial sequence
  SiRNA target sequence
aaattccaataatgtgttaatcac

SEQ ID NO: 248325 - DNA, 24 bp, Artificial sequence
  SiRNA target sequence
aattccaataatgtgttaatcaca

SEQ ID NO: 248326 - DNA, 24 bp, Artificial sequence
  SiRNA target sequence
attccaataatgtgttaatcacac

SEQ ID NO: 248327 - DNA, 24 bp, Artificial sequence
  SiRNA target sequence
ttccaataatgtgttaatcacaca

SEQ ID NO: 248328 - DNA, 24 bp, Artificial sequence
  SiRNA target sequence
tccaataatgtgttaatcacacat

SEQ ID NO: 248329 - DNA, 24 bp, Artificial sequence
  SiRNA target sequence
ccaataatgtgttaatcacacatg

SEQ ID NO: 248330 - DNA, 24 bp, Artificial sequence
  SiRNA target sequence
caataatgtgttaatcacacatgc

SEQ ID NO: 248331 - DNA, 24 bp, Artificial sequence
  SiRNA target sequence
aataatgtgttaatcacacatgcc

SEQ ID NO: 248332 - DNA, 24 bp, Artificial sequence
  SiRNA target sequence
ataatgtgttaatcacacatgcca

SEQ ID NO: 248333 - DNA, 24 bp, Artificial sequence
  SiRNA target sequence
taatgtgttaatcacacatgccat

SEQ ID NO: 248334 - DNA, 24 bp, Artificial sequence
  SiRNA target sequence
aatgtgttaatcacacatgccatt

SEQ ID NO: 248335 - DNA, 24 bp, Artificial sequence
  SiRNA target sequence
atgtgttaatcacacatgccatta

SEQ ID NO: 248336 - DNA, 24 bp, Artificial sequence
  SiRNA target sequence
tgtgttaatcacacatgccattaa

SEQ ID NO: 248337 - DNA, 24 bp, Artificial sequence
  SiRNA target sequence
gtgttaatcacacatgccattaaa

SEQ ID NO: 248338 - DNA, 24 bp, Artificial sequence
  SiRNA target sequence
tgttaatcacacatgccattaaaa

SEQ ID NO: 248339 - DNA, 24 bp, Artificial sequence
  SiRNA target sequence
gttaatcacacatgccattaaaaa

SEQ ID NO: 248340 - DNA, 24 bp, Artificial sequence
  SiRNA target sequence
ttaatcacacatgccattaaaaat

SEQ ID NO: 248341 - DNA, 24 bp, Artificial sequence
  SiRNA target sequence
taatcacacatgccattaaaaatg

SEQ ID NO: 248342 - DNA, 24 bp, Artificial sequence
  SiRNA target sequence
aatcacacatgccattaaaaatgt

SEQ ID NO: 248343 - DNA, 24 bp, Artificial sequence
  SiRNA target sequence
atcacacatgccattaaaaatgta

SEQ ID NO: 248344 - DNA, 24 bp, Artificial sequence
  SiRNA target sequence
tcacacatgccattaaaaatgtaa

SEQ ID NO: 248345 - DNA, 24 bp, Artificial sequence
  SiRNA target sequence
cacacatgccattaaaaatgtaag

SEQ ID NO: 248346 - DNA, 24 bp, Artificial sequence
  SiRNA target sequence
acacatgccattaaaaatgtaagt

SEQ ID NO: 248347 - DNA, 24 bp, Artificial sequence
  SiRNA target sequence
cacatgccattaaaaatgtaagtg

SEQ ID NO: 248348 - DNA, 24 bp, Artificial sequence
  SiRNA target sequence
acatgccattaaaaatgtaagtga

SEQ ID NO: 248349 - DNA, 24 bp, Artificial sequence
  SiRNA target sequence
catgccattaaaaatgtaagtgac

SEQ ID NO: 248350 - DNA, 24 bp, Artificial sequence
  SiRNA target sequence
atgccattaaaaatgtaagtgaca

SEQ ID NO: 248351 - DNA, 24 bp, Artificial sequence
  SiRNA target sequence
tgccattaaaaatgtaagtgacaa

SEQ ID NO: 248352 - DNA, 24 bp, Artificial sequence
  SiRNA target sequence
gccattaaaaatgtaagtgacaat

SEQ ID NO: 248353 - DNA, 24 bp, Artificial sequence
  SiRNA target sequence
ccattaaaaatgtaagtgacaata

SEQ ID NO: 248354 - DNA, 24 bp, Artificial sequence
  SiRNA target sequence
cattaaaaatgtaagtgacaataa

SEQ ID NO: 248355 - DNA, 24 bp, Artificial sequence
  SiRNA target sequence
attaaaaatgtaagtgacaataat

SEQ ID NO: 248356 - DNA, 24 bp, Artificial sequence
  SiRNA target sequence
ttaaaaatgtaagtgacaataata

SEQ ID NO: 248357 - DNA, 24 bp, Artificial sequence
  SiRNA target sequence
taaaaatgtaagtgacaataatat

SEQ ID NO: 248358 - DNA, 24 bp, Artificial sequence
  SiRNA target sequence
aaaaatgtaagtgacaataatatt

SEQ ID NO: 248359 - DNA, 24 bp, Artificial sequence
  SiRNA target sequence
aaaatgtaagtgacaataatattt

SEQ ID NO: 248360 - DNA, 24 bp, Artificial sequence
  SiRNA target sequence
aaatgtaagtgacaataatatttt

SEQ ID NO: 248361 - DNA, 24 bp, Artificial sequence
  SiRNA target sequence
aatgtaagtgacaataatattttt

SEQ ID NO: 248362 - DNA, 24 bp, Artificial sequence
  SiRNA target sequence
atgtaagtgacaataatattttta

SEQ ID NO: 248363 - DNA, 24 bp, Artificial sequence
  SiRNA target sequence
tgtaagtgacaataatatttttac

SEQ ID NO: 248364 - DNA, 24 bp, Artificial sequence
  SiRNA target sequence
gtaagtgacaataatatttttact

SEQ ID NO: 248365 - DNA, 24 bp, Artificial sequence
  SiRNA target sequence
taagtgacaataatatttttactt

SEQ ID NO: 248366 - DNA, 24 bp, Artificial sequence
  SiRNA target sequence
aagtgacaataatatttttacttt

SEQ ID NO: 248367 - DNA, 24 bp, Artificial sequence
  SiRNA target sequence
agtgacaataatatttttactttt

SEQ ID NO: 248368 - DNA, 24 bp, Artificial sequence
  SiRNA target sequence
gtgacaataatatttttacttttg

SEQ ID NO: 248369 - DNA, 24 bp, Artificial sequence
  SiRNA target sequence
tgacaataatatttttacttttgg

SEQ ID NO: 248370 - DNA, 24 bp, Artificial sequence
  SiRNA target sequence
gacaataatatttttacttttggg

SEQ ID NO: 248371 - DNA, 24 bp, Artificial sequence
  SiRNA target sequence
acaataatatttttacttttggga

SEQ ID NO: 248372 - DNA, 24 bp, Artificial sequence
  SiRNA target sequence
caataatatttttacttttgggaa

SEQ ID NO: 248373 - DNA, 24 bp, Artificial sequence
  SiRNA target sequence
aataatatttttacttttgggaat

SEQ ID NO: 248374 - DNA, 24 bp, Artificial sequence
  SiRNA target sequence
ataatatttttacttttgggaatt

SEQ ID NO: 248375 - DNA, 24 bp, Artificial sequence
  SiRNA target sequence
taatatttttacttttgggaattt

SEQ ID NO: 248376 - DNA, 24 bp, Artificial sequence
  SiRNA target sequence
aatatttttacttttgggaatttt

SEQ ID NO: 248377 - DNA, 24 bp, Artificial sequence
  SiRNA target sequence
atatttttacttttgggaattttt

SEQ ID NO: 248378 - DNA, 24 bp, Artificial sequence
  SiRNA target sequence
tatttttacttttgggaatttttt

SEQ ID NO: 248379 - DNA, 24 bp, Artificial sequence
  SiRNA target sequence
atttttacttttgggaattttttt

SEQ ID NO: 248380 - DNA, 24 bp, Artificial sequence
  SiRNA target sequence
tttttacttttgggaatttttttg

SEQ ID NO: 248381 - DNA, 24 bp, Artificial sequence
  SiRNA target sequence
ttttacttttgggaatttttttgt

SEQ ID NO: 248382 - DNA, 24 bp, Artificial sequence
  SiRNA target sequence
tttacttttgggaatttttttgtc

SEQ ID NO: 248383 - DNA, 24 bp, Artificial sequence
  SiRNA target sequence
ttacttttgggaatttttttgtct

SEQ ID NO: 248384 - DNA, 24 bp, Artificial sequence
  SiRNA target sequence
tacttttgggaatttttttgtctt

SEQ ID NO: 248385 - DNA, 24 bp, Artificial sequence
  SiRNA target sequence
acttttgggaatttttttgtctta

SEQ ID NO: 248386 - DNA, 24 bp, Artificial sequence
  SiRNA target sequence
cttttgggaatttttttgtcttag

SEQ ID NO: 248387 - DNA, 24 bp, Artificial sequence
  SiRNA target sequence
ttttgggaatttttttgtcttagt

SEQ ID NO: 248388 - DNA, 24 bp, Artificial sequence
  SiRNA target sequence
tttgggaatttttttgtcttagtc

SEQ ID NO: 248389 - DNA, 24 bp, Artificial sequence
  SiRNA target sequence
ttgggaatttttttgtcttagtca

SEQ ID NO: 248390 - DNA, 24 bp, Artificial sequence
  SiRNA target sequence
tgggaatttttttgtcttagtcat

SEQ ID NO: 248391 - DNA, 25 bp, Artificial sequence
  SiRNA target sequence
ttaattaaaatcaacatctatctca

SEQ ID NO: 248392 - DNA, 25 bp, Artificial sequence
  SiRNA target sequence
taattaaaatcaacatctatctcag

SEQ ID NO: 248393 - DNA, 25 bp, Artificial sequence
  SiRNA target sequence
aattaaaatcaacatctatctcaga

SEQ ID NO: 248394 - DNA, 25 bp, Artificial sequence
  SiRNA target sequence
attaaaatcaacatctatctcagaa

SEQ ID NO: 248395 - DNA, 25 bp, Artificial sequence
  SiRNA target sequence
ttaaaatcaacatctatctcagaat

SEQ ID NO: 248396 - DNA, 25 bp, Artificial sequence
  SiRNA target sequence
taaaatcaacatctatctcagaatt

SEQ ID NO: 248397 - DNA, 25 bp, Artificial sequence
  SiRNA target sequence
aaaatcaacatctatctcagaattt

SEQ ID NO: 248398 - DNA, 25 bp, Artificial sequence
  SiRNA target sequence
aaatcaacatctatctcagaatttt

SEQ ID NO: 248399 - DNA, 25 bp, Artificial sequence
  SiRNA target sequence
aatcaacatctatctcagaattttg

SEQ ID NO: 248400 - DNA, 25 bp, Artificial sequence
  SiRNA target sequence
atcaacatctatctcagaattttgt

SEQ ID NO: 248401 - DNA, 25 bp, Artificial sequence
  SiRNA target sequence
tcaacatctatctcagaattttgtt

SEQ ID NO: 248402 - DNA, 25 bp, Artificial sequence
  SiRNA target sequence
caacatctatctcagaattttgttc

SEQ ID NO: 248403 - DNA, 25 bp, Artificial sequence
  SiRNA target sequence
aacatctatctcagaattttgttca

SEQ ID NO: 248404 - DNA, 25 bp, Artificial sequence
  SiRNA target sequence
acatctatctcagaattttgttcaa

SEQ ID NO: 248405 - DNA, 25 bp, Artificial sequence
  SiRNA target sequence
catctatctcagaattttgttcaat

SEQ ID NO: 248406 - DNA, 25 bp, Artificial sequence
  SiRNA target sequence
atctatctcagaattttgttcaatt

SEQ ID NO: 248407 - DNA, 25 bp, Artificial sequence
  SiRNA target sequence
tctatctcagaattttgttcaattg

SEQ ID NO: 248408 - DNA, 25 bp, Artificial sequence
  SiRNA target sequence
ctatctcagaattttgttcaattga

SEQ ID NO: 248409 - DNA, 25 bp, Artificial sequence
  SiRNA target sequence
tatctcagaattttgttcaattgat

SEQ ID NO: 248410 - DNA, 25 bp, Artificial sequence
  SiRNA target sequence
atctcagaattttgttcaattgatt

SEQ ID NO: 248411 - DNA, 25 bp, Artificial sequence
  SiRNA target sequence
tctcagaattttgttcaattgattc

SEQ ID NO: 248412 - DNA, 25 bp, Artificial sequence
  SiRNA target sequence
ctcagaattttgttcaattgattca

SEQ ID NO: 248413 - DNA, 25 bp, Artificial sequence
  SiRNA target sequence
tcagaattttgttcaattgattcat

SEQ ID NO: 248414 - DNA, 25 bp, Artificial sequence
  SiRNA target sequence
cagaattttgttcaattgattcatt

SEQ ID NO: 248415 - DNA, 25 bp, Artificial sequence
  SiRNA target sequence
agaattttgttcaattgattcatta

SEQ ID NO: 248416 - DNA, 25 bp, Artificial sequence
  SiRNA target sequence
gaattttgttcaattgattcattat

SEQ ID NO: 248417 - DNA, 25 bp, Artificial sequence
  SiRNA target sequence
aattttgttcaattgattcattata

SEQ ID NO: 248418 - DNA, 25 bp, Artificial sequence
  SiRNA target sequence
attttgttcaattgattcattatat

SEQ ID NO: 248419 - DNA, 25 bp, Artificial sequence
  SiRNA target sequence
ttttgttcaattgattcattatatt

SEQ ID NO: 248420 - DNA, 25 bp, Artificial sequence
  SiRNA target sequence
tttgttcaattgattcattatattt

SEQ ID NO: 248421 - DNA, 25 bp, Artificial sequence
  SiRNA target sequence
ttgttcaattgattcattatatttt

SEQ ID NO: 248422 - DNA, 25 bp, Artificial sequence
  SiRNA target sequence
tgttcaattgattcattatattttt

SEQ ID NO: 248423 - DNA, 25 bp, Artificial sequence
  SiRNA target sequence
gttcaattgattcattatatttttt

SEQ ID NO: 248424 - DNA, 25 bp, Artificial sequence
  SiRNA target sequence
ttcaattgattcattatatttttta

SEQ ID NO: 248425 - DNA, 25 bp, Artificial sequence
  SiRNA target sequence
tcaattgattcattatattttttac

SEQ ID NO: 248426 - DNA, 25 bp, Artificial sequence
  SiRNA target sequence
caattgattcattatattttttact

SEQ ID NO: 248427 - DNA, 25 bp, Artificial sequence
  SiRNA target sequence
aattgattcattatattttttactt

SEQ ID NO: 248428 - DNA, 25 bp, Artificial sequence
  SiRNA target sequence
attgattcattatattttttactta

SEQ ID NO: 248429 - DNA, 25 bp, Artificial sequence
  SiRNA target sequence
ttgattcattatattttttacttaa

SEQ ID NO: 248430 - DNA, 25 bp, Artificial sequence
  SiRNA target sequence
tgattcattatattttttacttaaa

SEQ ID NO: 248431 - DNA, 25 bp, Artificial sequence
  SiRNA target sequence
gattcattatattttttacttaaat

SEQ ID NO: 248432 - DNA, 25 bp, Artificial sequence
  SiRNA target sequence
attcattatattttttacttaaata

SEQ ID NO: 248433 - DNA, 25 bp, Artificial sequence
  SiRNA target sequence
ttcattatattttttacttaaataa

SEQ ID NO: 248434 - DNA, 25 bp, Artificial sequence
  SiRNA target sequence
tcattatattttttacttaaataac

SEQ ID NO: 248435 - DNA, 25 bp, Artificial sequence
  SiRNA target sequence
cattatattttttacttaaataaca

SEQ ID NO: 248436 - DNA, 25 bp, Artificial sequence
  SiRNA target sequence
attatattttttacttaaataacag

SEQ ID NO: 248437 - DNA, 25 bp, Artificial sequence
  SiRNA target sequence
ttatattttttacttaaataacaga

SEQ ID NO: 248438 - DNA, 25 bp, Artificial sequence
  SiRNA target sequence
tatattttttacttaaataacagac

SEQ ID NO: 248439 - DNA, 25 bp, Artificial sequence
  SiRNA target sequence
atattttttacttaaataacagaca

SEQ ID NO: 248440 - DNA, 25 bp, Artificial sequence
  SiRNA target sequence
tattttttacttaaataacagacac

SEQ ID NO: 248441 - DNA, 25 bp, Artificial sequence
  SiRNA target sequence
attttttacttaaataacagacact

SEQ ID NO: 248442 - DNA, 25 bp, Artificial sequence
  SiRNA target sequence
ttttttacttaaataacagacactc

SEQ ID NO: 248443 - DNA, 25 bp, Artificial sequence
  SiRNA target sequence
tttttacttaaataacagacactcc

SEQ ID NO: 248444 - DNA, 25 bp, Artificial sequence
  SiRNA target sequence
ttttacttaaataacagacactcct

SEQ ID NO: 248445 - DNA, 25 bp, Artificial sequence
  SiRNA target sequence
tttacttaaataacagacactcctg

SEQ ID NO: 248446 - DNA, 25 bp, Artificial sequence
  SiRNA target sequence
ttacttaaataacagacactcctga

SEQ ID NO: 248447 - DNA, 25 bp, Artificial sequence
  SiRNA target sequence
tacttaaataacagacactcctgat

SEQ ID NO: 248448 - DNA, 25 bp, Artificial sequence
  SiRNA target sequence
acttaaataacagacactcctgatc

SEQ ID NO: 248449 - DNA, 25 bp, Artificial sequence
  SiRNA target sequence
cttaaataacagacactcctgatcc

SEQ ID NO: 248450 - DNA, 25 bp, Artificial sequence
  SiRNA target sequence
ttaaataacagacactcctgatcca

SEQ ID NO: 248451 - DNA, 25 bp, Artificial sequence
  SiRNA target sequence
taaataacagacactcctgatccac

SEQ ID NO: 248452 - DNA, 25 bp, Artificial sequence
  SiRNA target sequence
aaataacagacactcctgatccaca

SEQ ID NO: 248453 - DNA, 25 bp, Artificial sequence
  SiRNA target sequence
aataacagacactcctgatccacaa

SEQ ID NO: 248454 - DNA, 25 bp, Artificial sequence
  SiRNA target sequence
ataacagacactcctgatccacaaa

SEQ ID NO: 248455 - DNA, 25 bp, Artificial sequence
  SiRNA target sequence
taacagacactcctgatccacaaaa

SEQ ID NO: 248456 - DNA, 25 bp, Artificial sequence
  SiRNA target sequence
aacagacactcctgatccacaaaaa

SEQ ID NO: 248457 - DNA, 25 bp, Artificial sequence
  SiRNA target sequence
acagacactcctgatccacaaaaaa

SEQ ID NO: 248458 - DNA, 25 bp, Artificial sequence
  SiRNA target sequence
cagacactcctgatccacaaaaaat

SEQ ID NO: 248459 - DNA, 25 bp, Artificial sequence
  SiRNA target sequence
agacactcctgatccacaaaaaatt

SEQ ID NO: 248460 - DNA, 25 bp, Artificial sequence
  SiRNA target sequence
gacactcctgatccacaaaaaattt

SEQ ID NO: 248461 - DNA, 25 bp, Artificial sequence
  SiRNA target sequence
acactcctgatccacaaaaaatttg

SEQ ID NO: 248462 - DNA, 25 bp, Artificial sequence
  SiRNA target sequence
cactcctgatccacaaaaaatttgc

SEQ ID NO: 248463 - DNA, 25 bp, Artificial sequence
  SiRNA target sequence
actcctgatccacaaaaaatttgca

SEQ ID NO: 248464 - DNA, 25 bp, Artificial sequence
  SiRNA target sequence
ctcctgatccacaaaaaatttgcaa

SEQ ID NO: 248465 - DNA, 25 bp, Artificial sequence
  SiRNA target sequence
tcctgatccacaaaaaatttgcaaa

SEQ ID NO: 248466 - DNA, 25 bp, Artificial sequence
  SiRNA target sequence
cctgatccacaaaaaatttgcaaat

SEQ ID NO: 248467 - DNA, 25 bp, Artificial sequence
  SiRNA target sequence
ctgatccacaaaaaatttgcaaata

SEQ ID NO: 248468 - DNA, 25 bp, Artificial sequence
  SiRNA target sequence
tgatccacaaaaaatttgcaaatat

SEQ ID NO: 248469 - DNA, 25 bp, Artificial sequence
  SiRNA target sequence
gatccacaaaaaatttgcaaatatt

SEQ ID NO: 248470 - DNA, 25 bp, Artificial sequence
  SiRNA target sequence
atccacaaaaaatttgcaaatatta

SEQ ID NO: 248471 - DNA, 25 bp, Artificial sequence
  SiRNA target sequence
tccacaaaaaatttgcaaatattaa

SEQ ID NO: 248472 - DNA, 25 bp, Artificial sequence
  SiRNA target sequence
ccacaaaaaatttgcaaatattaaa

SEQ ID NO: 248473 - DNA, 25 bp, Artificial sequence
  SiRNA target sequence
cacaaaaaatttgcaaatattaaaa

SEQ ID NO: 248474 - DNA, 25 bp, Artificial sequence
  SiRNA target sequence
acaaaaaatttgcaaatattaaaaa

SEQ ID NO: 248475 - DNA, 25 bp, Artificial sequence
  SiRNA target sequence
caaaaaatttgcaaatattaaaaat

SEQ ID NO: 248476 - DNA, 25 bp, Artificial sequence
  SiRNA target sequence
aaaaaatttgcaaatattaaaaata

SEQ ID NO: 248477 - DNA, 25 bp, Artificial sequence
  SiRNA target sequence
aaaaatttgcaaatattaaaaatat

SEQ ID NO: 248478 - DNA, 25 bp, Artificial sequence
  SiRNA target sequence
aaaatttgcaaatattaaaaatata

SEQ ID NO: 248479 - DNA, 25 bp, Artificial sequence
  SiRNA target sequence
aaatttgcaaatattaaaaatataa

SEQ ID NO: 248480 - DNA, 25 bp, Artificial sequence
  SiRNA target sequence
aatttgcaaatattaaaaatataaa

SEQ ID NO: 248481 - DNA, 25 bp, Artificial sequence
  SiRNA target sequence
atttgcaaatattaaaaatataaaa

SEQ ID NO: 248482 - DNA, 25 bp, Artificial sequence
  SiRNA target sequence
tttgcaaatattaaaaatataaaag

SEQ ID NO: 248483 - DNA, 25 bp, Artificial sequence
  SiRNA target sequence
ttgcaaatattaaaaatataaaaga

SEQ ID NO: 248484 - DNA, 25 bp, Artificial sequence
  SiRNA target sequence
tgcaaatattaaaaatataaaagac

SEQ ID NO: 248485 - DNA, 25 bp, Artificial sequence
  SiRNA target sequence
gcaaatattaaaaatataaaagaca

SEQ ID NO: 248486 - DNA, 25 bp, Artificial sequence
  SiRNA target sequence
caaatattaaaaatataaaagacac

SEQ ID NO: 248487 - DNA, 25 bp, Artificial sequence
  SiRNA target sequence
aaatattaaaaatataaaagacacg

SEQ ID NO: 248488 - DNA, 25 bp, Artificial sequence
  SiRNA target sequence
aatattaaaaatataaaagacacgt

SEQ ID NO: 248489 - DNA, 25 bp, Artificial sequence
  SiRNA target sequence
atattaaaaatataaaagacacgta

SEQ ID NO: 248490 - DNA, 25 bp, Artificial sequence
  SiRNA target sequence
tattaaaaatataaaagacacgtat

SEQ ID NO: 248491 - DNA, 25 bp, Artificial sequence
  SiRNA target sequence
attaaaaatataaaagacacgtatg

SEQ ID NO: 248492 - DNA, 25 bp, Artificial sequence
  SiRNA target sequence
ttaaaaatataaaagacacgtatga

SEQ ID NO: 248493 - DNA, 25 bp, Artificial sequence
  SiRNA target sequence
taaaaatataaaagacacgtatgat

SEQ ID NO: 248494 - DNA, 25 bp, Artificial sequence
  SiRNA target sequence
aaaaatataaaagacacgtatgata

SEQ ID NO: 248495 - DNA, 25 bp, Artificial sequence
  SiRNA target sequence
aaaatataaaagacacgtatgatac

SEQ ID NO: 248496 - DNA, 25 bp, Artificial sequence
  SiRNA target sequence
aaatataaaagacacgtatgatact

SEQ ID NO: 248497 - DNA, 25 bp, Artificial sequence
  SiRNA target sequence
aatataaaagacacgtatgatactt

SEQ ID NO: 248498 - DNA, 25 bp, Artificial sequence
  SiRNA target sequence
atataaaagacacgtatgatacttg

SEQ ID NO: 248499 - DNA, 25 bp, Artificial sequence
  SiRNA target sequence
tataaaagacacgtatgatacttgt

SEQ ID NO: 248500 - DNA, 25 bp, Artificial sequence
  SiRNA target sequence
ataaaagacacgtatgatacttgtc

SEQ ID NO: 248501 - DNA, 25 bp, Artificial sequence
  SiRNA target sequence
taaaagacacgtatgatacttgtct

SEQ ID NO: 248502 - DNA, 25 bp, Artificial sequence
  SiRNA target sequence
aaaagacacgtatgatacttgtcta

SEQ ID NO: 248503 - DNA, 25 bp, Artificial sequence
  SiRNA target sequence
aaagacacgtatgatacttgtctaa

SEQ ID NO: 248504 - DNA, 25 bp, Artificial sequence
  SiRNA target sequence
aagacacgtatgatacttgtctaat

SEQ ID NO: 248505 - DNA, 25 bp, Artificial sequence
  SiRNA target sequence
agacacgtatgatacttgtctaata

SEQ ID NO: 248506 - DNA, 25 bp, Artificial sequence
  SiRNA target sequence
gacacgtatgatacttgtctaatat

SEQ ID NO: 248507 - DNA, 25 bp, Artificial sequence
  SiRNA target sequence
acacgtatgatacttgtctaatatc

SEQ ID NO: 248508 - DNA, 25 bp, Artificial sequence
  SiRNA target sequence
cacgtatgatacttgtctaatatct

SEQ ID NO: 248509 - DNA, 25 bp, Artificial sequence
  SiRNA target sequence
acgtatgatacttgtctaatatctg

SEQ ID NO: 248510 - DNA, 25 bp, Artificial sequence
  SiRNA target sequence
cgtatgatacttgtctaatatctgg

SEQ ID NO: 248511 - DNA, 25 bp, Artificial sequence
  SiRNA target sequence
gtatgatacttgtctaatatctgga

SEQ ID NO: 248512 - DNA, 25 bp, Artificial sequence
  SiRNA target sequence
tatgatacttgtctaatatctggaa

SEQ ID NO: 248513 - DNA, 25 bp, Artificial sequence
  SiRNA target sequence
atgatacttgtctaatatctggaat

SEQ ID NO: 248514 - DNA, 25 bp, Artificial sequence
  SiRNA target sequence
tgatacttgtctaatatctggaatt

SEQ ID NO: 248515 - DNA, 25 bp, Artificial sequence
  SiRNA target sequence
gatacttgtctaatatctggaattt

SEQ ID NO: 248516 - DNA, 25 bp, Artificial sequence
  SiRNA target sequence
atacttgtctaatatctggaatttc

SEQ ID NO: 248517 - DNA, 25 bp, Artificial sequence
  SiRNA target sequence
tacttgtctaatatctggaatttct

SEQ ID NO: 248518 - DNA, 25 bp, Artificial sequence
  SiRNA target sequence
acttgtctaatatctggaatttcta

SEQ ID NO: 248519 - DNA, 25 bp, Artificial sequence
  SiRNA target sequence
cttgtctaatatctggaatttctat

SEQ ID NO: 248520 - DNA, 25 bp, Artificial sequence
  SiRNA target sequence
ttgtctaatatctggaatttctata

SEQ ID NO: 248521 - DNA, 25 bp, Artificial sequence
  SiRNA target sequence
tgtctaatatctggaatttctataa

SEQ ID NO: 248522 - DNA, 25 bp, Artificial sequence
  SiRNA target sequence
gtctaatatctggaatttctataaa

SEQ ID NO: 248523 - DNA, 25 bp, Artificial sequence
  SiRNA target sequence
tctaatatctggaatttctataaac

SEQ ID NO: 248524 - DNA, 25 bp, Artificial sequence
  SiRNA target sequence
ctaatatctggaatttctataaacg

SEQ ID NO: 248525 - DNA, 25 bp, Artificial sequence
  SiRNA target sequence
taatatctggaatttctataaacgt

SEQ ID NO: 248526 - DNA, 25 bp, Artificial sequence
  SiRNA target sequence
aatatctggaatttctataaacgtc

SEQ ID NO: 248527 - DNA, 25 bp, Artificial sequence
  SiRNA target sequence
atatctggaatttctataaacgtca

SEQ ID NO: 248528 - DNA, 25 bp, Artificial sequence
  SiRNA target sequence
tatctggaatttctataaacgtcaa

SEQ ID NO: 248529 - DNA, 25 bp, Artificial sequence
  SiRNA target sequence
atctggaatttctataaacgtcaaa

SEQ ID NO: 248530 - DNA, 25 bp, Artificial sequence
  SiRNA target sequence
tctggaatttctataaacgtcaaaa

SEQ ID NO: 248531 - DNA, 25 bp, Artificial sequence
  SiRNA target sequence
ctggaatttctataaacgtcaaaaa

SEQ ID NO: 248532 - DNA, 25 bp, Artificial sequence
  SiRNA target sequence
tggaatttctataaacgtcaaaaaa

SEQ ID NO: 248533 - DNA, 25 bp, Artificial sequence
  SiRNA target sequence
ggaatttctataaacgtcaaaaaag

SEQ ID NO: 248534 - DNA, 25 bp, Artificial sequence
  SiRNA target sequence
gaatttctataaacgtcaaaaaagt

SEQ ID NO: 248535 - DNA, 25 bp, Artificial sequence
  SiRNA target sequence
aatttctataaacgtcaaaaaagtt

SEQ ID NO: 248536 - DNA, 25 bp, Artificial sequence
  SiRNA target sequence
atttctataaacgtcaaaaaagttc

SEQ ID NO: 248537 - DNA, 25 bp, Artificial sequence
  SiRNA target sequence
tttctataaacgtcaaaaaagttcc

SEQ ID NO: 248538 - DNA, 25 bp, Artificial sequence
  SiRNA target sequence
ttctataaacgtcaaaaaagttcca

SEQ ID NO: 248539 - DNA, 25 bp, Artificial sequence
  SiRNA target sequence
tctataaacgtcaaaaaagttccat

SEQ ID NO: 248540 - DNA, 25 bp, Artificial sequence
  SiRNA target sequence
ctataaacgtcaaaaaagttccata

SEQ ID NO: 248541 - DNA, 25 bp, Artificial sequence
  SiRNA target sequence
tataaacgtcaaaaaagttccatat

SEQ ID NO: 248542 - DNA, 25 bp, Artificial sequence
  SiRNA target sequence
ataaacgtcaaaaaagttccatata

SEQ ID NO: 248543 - DNA, 25 bp, Artificial sequence
  SiRNA target sequence
taaacgtcaaaaaagttccatataa

SEQ ID NO: 248544 - DNA, 25 bp, Artificial sequence
  SiRNA target sequence
aaacgtcaaaaaagttccatataaa

SEQ ID NO: 248545 - DNA, 25 bp, Artificial sequence
  SiRNA target sequence
aacgtcaaaaaagttccatataaag

SEQ ID NO: 248546 - DNA, 25 bp, Artificial sequence
  SiRNA target sequence
acgtcaaaaaagttccatataaaga

SEQ ID NO: 248547 - DNA, 25 bp, Artificial sequence
  SiRNA target sequence
cgtcaaaaaagttccatataaagag

SEQ ID NO: 248548 - DNA, 25 bp, Artificial sequence
  SiRNA target sequence
gtcaaaaaagttccatataaagaga

SEQ ID NO: 248549 - DNA, 25 bp, Artificial sequence
  SiRNA target sequence
tcaaaaaagttccatataaagagat

SEQ ID NO: 248550 - DNA, 25 bp, Artificial sequence
  SiRNA target sequence
caaaaaagttccatataaagagata

SEQ ID NO: 248551 - DNA, 25 bp, Artificial sequence
  SiRNA target sequence
aaaaaagttccatataaagagataa

SEQ ID NO: 248552 - DNA, 25 bp, Artificial sequence
  SiRNA target sequence
aaaaagttccatataaagagataat

SEQ ID NO: 248553 - DNA, 25 bp, Artificial sequence
  SiRNA target sequence
aaaagttccatataaagagataata

SEQ ID NO: 248554 - DNA, 25 bp, Artificial sequence
  SiRNA target sequence
aaagttccatataaagagataatag

SEQ ID NO: 248555 - DNA, 25 bp, Artificial sequence
  SiRNA target sequence
aagttccatataaagagataataga

SEQ ID NO: 248556 - DNA, 25 bp, Artificial sequence
  SiRNA target sequence
agttccatataaagagataatagat

SEQ ID NO: 248557 - DNA, 25 bp, Artificial sequence
  SiRNA target sequence
gttccatataaagagataatagatt

SEQ ID NO: 248558 - DNA, 25 bp, Artificial sequence
  SiRNA target sequence
ttccatataaagagataatagattt

SEQ ID NO: 248559 - DNA, 25 bp, Artificial sequence
  SiRNA target sequence
tccatataaagagataatagattta

SEQ ID NO: 248560 - DNA, 25 bp, Artificial sequence
  SiRNA target sequence
ccatataaagagataatagatttac

SEQ ID NO: 248561 - DNA, 25 bp, Artificial sequence
  SiRNA target sequence
catataaagagataatagatttacc

SEQ ID NO: 248562 - DNA, 25 bp, Artificial sequence
  SiRNA target sequence
atataaagagataatagatttacca

SEQ ID NO: 248563 - DNA, 25 bp, Artificial sequence
  SiRNA target sequence
tataaagagataatagatttaccaa

SEQ ID NO: 248564 - DNA, 25 bp, Artificial sequence
  SiRNA target sequence
ataaagagataatagatttaccaat

SEQ ID NO: 248565 - DNA, 25 bp, Artificial sequence
  SiRNA target sequence
taaagagataatagatttaccaatt

SEQ ID NO: 248566 - DNA, 25 bp, Artificial sequence
  SiRNA target sequence
aaagagataatagatttaccaattt

SEQ ID NO: 248567 - DNA, 25 bp, Artificial sequence
  SiRNA target sequence
aagagataatagatttaccaatttt

SEQ ID NO: 248568 - DNA, 25 bp, Artificial sequence
  SiRNA target sequence
agagataatagatttaccaattttg

SEQ ID NO: 248569 - DNA, 25 bp, Artificial sequence
  SiRNA target sequence
gagataatagatttaccaattttga

SEQ ID NO: 248570 - DNA, 25 bp, Artificial sequence
  SiRNA target sequence
agataatagatttaccaattttgat

SEQ ID NO: 248571 - DNA, 25 bp, Artificial sequence
  SiRNA target sequence
gataatagatttaccaattttgata

SEQ ID NO: 248572 - DNA, 25 bp, Artificial sequence
  SiRNA target sequence
ataatagatttaccaattttgatac

SEQ ID NO: 248573 - DNA, 25 bp, Artificial sequence
  SiRNA target sequence
taatagatttaccaattttgataca

SEQ ID NO: 248574 - DNA, 25 bp, Artificial sequence
  SiRNA target sequence
aatagatttaccaattttgatacat

SEQ ID NO: 248575 - DNA, 25 bp, Artificial sequence
  SiRNA target sequence
atagatttaccaattttgatacata

SEQ ID NO: 248576 - DNA, 25 bp, Artificial sequence
  SiRNA target sequence
tagatttaccaattttgatacatac

SEQ ID NO: 248577 - DNA, 25 bp, Artificial sequence
  SiRNA target sequence
agatttaccaattttgatacataca

SEQ ID NO: 248578 - DNA, 25 bp, Artificial sequence
  SiRNA target sequence
gatttaccaattttgatacatacac

SEQ ID NO: 248579 - DNA, 25 bp, Artificial sequence
  SiRNA target sequence
atttaccaattttgatacatacacc

SEQ ID NO: 248580 - DNA, 25 bp, Artificial sequence
  SiRNA target sequence
tttaccaattttgatacatacacca

SEQ ID NO: 248581 - DNA, 25 bp, Artificial sequence
  SiRNA target sequence
ttaccaattttgatacatacaccat

SEQ ID NO: 248582 - DNA, 25 bp, Artificial sequence
  SiRNA target sequence
taccaattttgatacatacaccatc

SEQ ID NO: 248583 - DNA, 25 bp, Artificial sequence
  SiRNA target sequence
accaattttgatacatacaccatca

SEQ ID NO: 248584 - DNA, 25 bp, Artificial sequence
  SiRNA target sequence
ccaattttgatacatacaccatcat

SEQ ID NO: 248585 - DNA, 25 bp, Artificial sequence
  SiRNA target sequence
caattttgatacatacaccatcata

SEQ ID NO: 248586 - DNA, 25 bp, Artificial sequence
  SiRNA target sequence
aattttgatacatacaccatcataa

SEQ ID NO: 248587 - DNA, 25 bp, Artificial sequence
  SiRNA target sequence
attttgatacatacaccatcataaa

SEQ ID NO: 248588 - DNA, 25 bp, Artificial sequence
  SiRNA target sequence
ttttgatacatacaccatcataaaa

SEQ ID NO: 248589 - DNA, 25 bp, Artificial sequence
  SiRNA target sequence
tttgatacatacaccatcataaaaa

SEQ ID NO: 248590 - DNA, 25 bp, Artificial sequence
  SiRNA target sequence
ttgatacatacaccatcataaaaac

SEQ ID NO: 248591 - DNA, 25 bp, Artificial sequence
  SiRNA target sequence
tgatacatacaccatcataaaaact

SEQ ID NO: 248592 - DNA, 25 bp, Artificial sequence
  SiRNA target sequence
gatacatacaccatcataaaaactt

SEQ ID NO: 248593 - DNA, 25 bp, Artificial sequence
  SiRNA target sequence
atacatacaccatcataaaaacttt

SEQ ID NO: 248594 - DNA, 25 bp, Artificial sequence
  SiRNA target sequence
tacatacaccatcataaaaactttt

SEQ ID NO: 248595 - DNA, 25 bp, Artificial sequence
  SiRNA target sequence
acatacaccatcataaaaactttta

SEQ ID NO: 248596 - DNA, 25 bp, Artificial sequence
  SiRNA target sequence
catacaccatcataaaaacttttaa

SEQ ID NO: 248597 - DNA, 25 bp, Artificial sequence
  SiRNA target sequence
atacaccatcataaaaacttttaaa

SEQ ID NO: 248598 - DNA, 25 bp, Artificial sequence
  SiRNA target sequence
tacaccatcataaaaacttttaaat

SEQ ID NO: 248599 - DNA, 25 bp, Artificial sequence
  SiRNA target sequence
acaccatcataaaaacttttaaatt

SEQ ID NO: 248600 - DNA, 25 bp, Artificial sequence
  SiRNA target sequence
caccatcataaaaacttttaaattt

SEQ ID NO: 248601 - DNA, 25 bp, Artificial sequence
  SiRNA target sequence
accatcataaaaacttttaaattta

SEQ ID NO: 248602 - DNA, 25 bp, Artificial sequence
  SiRNA target sequence
ccatcataaaaacttttaaatttat

SEQ ID NO: 248603 - DNA, 25 bp, Artificial sequence
  SiRNA target sequence
catcataaaaacttttaaatttata

SEQ ID NO: 248604 - DNA, 25 bp, Artificial sequence
  SiRNA target sequence
atcataaaaacttttaaatttatac

SEQ ID NO: 248605 - DNA, 25 bp, Artificial sequence
  SiRNA target sequence
tcataaaaacttttaaatttatacc

SEQ ID NO: 248606 - DNA, 25 bp, Artificial sequence
  SiRNA target sequence
cataaaaacttttaaatttatacct

SEQ ID NO: 248607 - DNA, 25 bp, Artificial sequence
  SiRNA target sequence
ataaaaacttttaaatttatacctg

SEQ ID NO: 248608 - DNA, 25 bp, Artificial sequence
  SiRNA target sequence
taaaaacttttaaatttatacctgt

SEQ ID NO: 248609 - DNA, 25 bp, Artificial sequence
  SiRNA target sequence
aaaaacttttaaatttatacctgta

SEQ ID NO: 248610 - DNA, 25 bp, Artificial sequence
  SiRNA target sequence
aaaacttttaaatttatacctgtat

SEQ ID NO: 248611 - DNA, 25 bp, Artificial sequence
  SiRNA target sequence
aaacttttaaatttatacctgtatt

SEQ ID NO: 248612 - DNA, 25 bp, Artificial sequence
  SiRNA target sequence
aacttttaaatttatacctgtattt

SEQ ID NO: 248613 - DNA, 25 bp, Artificial sequence
  SiRNA target sequence
acttttaaatttatacctgtattta

SEQ ID NO: 248614 - DNA, 25 bp, Artificial sequence
  SiRNA target sequence
cttttaaatttatacctgtatttaa

SEQ ID NO: 248615 - DNA, 25 bp, Artificial sequence
  SiRNA target sequence
ttttaaatttatacctgtatttaac

SEQ ID NO: 248616 - DNA, 25 bp, Artificial sequence
  SiRNA target sequence
tttaaatttatacctgtatttaaca

SEQ ID NO: 248617 - DNA, 25 bp, Artificial sequence
  SiRNA target sequence
ttaaatttatacctgtatttaacag

SEQ ID NO: 248618 - DNA, 25 bp, Artificial sequence
  SiRNA target sequence
taaatttatacctgtatttaacagg

SEQ ID NO: 248619 - DNA, 25 bp, Artificial sequence
  SiRNA target sequence
aaatttatacctgtatttaacaggc

SEQ ID NO: 248620 - DNA, 25 bp, Artificial sequence
  SiRNA target sequence
aatttatacctgtatttaacaggca

SEQ ID NO: 248621 - DNA, 25 bp, Artificial sequence
  SiRNA target sequence
atttatacctgtatttaacaggcac

SEQ ID NO: 248622 - DNA, 25 bp, Artificial sequence
  SiRNA target sequence
tttatacctgtatttaacaggcacc

SEQ ID NO: 248623 - DNA, 25 bp, Artificial sequence
  SiRNA target sequence
ttatacctgtatttaacaggcaccc

SEQ ID NO: 248624 - DNA, 25 bp, Artificial sequence
  SiRNA target sequence
tatacctgtatttaacaggcaccct

SEQ ID NO: 248625 - DNA, 25 bp, Artificial sequence
  SiRNA target sequence
atacctgtatttaacaggcaccctc

SEQ ID NO: 248626 - DNA, 25 bp, Artificial sequence
  SiRNA target sequence
tacctgtatttaacaggcaccctca

SEQ ID NO: 248627 - DNA, 25 bp, Artificial sequence
  SiRNA target sequence
acctgtatttaacaggcaccctcat

SEQ ID NO: 248628 - DNA, 25 bp, Artificial sequence
  SiRNA target sequence
cctgtatttaacaggcaccctcata

SEQ ID NO: 248629 - DNA, 25 bp, Artificial sequence
  SiRNA target sequence
ctgtatttaacaggcaccctcatag

SEQ ID NO: 248630 - DNA, 25 bp, Artificial sequence
  SiRNA target sequence
tgtatttaacaggcaccctcataga

SEQ ID NO: 248631 - DNA, 25 bp, Artificial sequence
  SiRNA target sequence
gtatttaacaggcaccctcatagaa

SEQ ID NO: 248632 - DNA, 25 bp, Artificial sequence
  SiRNA target sequence
tatttaacaggcaccctcatagaaa

SEQ ID NO: 248633 - DNA, 25 bp, Artificial sequence
  SiRNA target sequence
atttaacaggcaccctcatagaaag

SEQ ID NO: 248634 - DNA, 25 bp, Artificial sequence
  SiRNA target sequence
tttaacaggcaccctcatagaaagc

SEQ ID NO: 248635 - DNA, 25 bp, Artificial sequence
  SiRNA target sequence
ttaacaggcaccctcatagaaagca

SEQ ID NO: 248636 - DNA, 25 bp, Artificial sequence
  SiRNA target sequence
taacaggcaccctcatagaaagcat

SEQ ID NO: 248637 - DNA, 25 bp, Artificial sequence
  SiRNA target sequence
aacaggcaccctcatagaaagcatt

SEQ ID NO: 248638 - DNA, 25 bp, Artificial sequence
  SiRNA target sequence
acaggcaccctcatagaaagcattt

SEQ ID NO: 248639 - DNA, 25 bp, Artificial sequence
  SiRNA target sequence
caggcaccctcatagaaagcatttc

SEQ ID NO: 248640 - DNA, 25 bp, Artificial sequence
  SiRNA target sequence
aggcaccctcatagaaagcatttct

SEQ ID NO: 248641 - DNA, 25 bp, Artificial sequence
  SiRNA target sequence
ggcaccctcatagaaagcatttctt

SEQ ID NO: 248642 - DNA, 25 bp, Artificial sequence
  SiRNA target sequence
gcaccctcatagaaagcatttcttt

SEQ ID NO: 248643 - DNA, 25 bp, Artificial sequence
  SiRNA target sequence
caccctcatagaaagcatttctttt

SEQ ID NO: 248644 - DNA, 25 bp, Artificial sequence
  SiRNA target sequence
accctcatagaaagcatttcttttg

SEQ ID NO: 248645 - DNA, 25 bp, Artificial sequence
  SiRNA target sequence
ccctcatagaaagcatttcttttgc

SEQ ID NO: 248646 - DNA, 25 bp, Artificial sequence
  SiRNA target sequence
cctcatagaaagcatttcttttgct

SEQ ID NO: 248647 - DNA, 25 bp, Artificial sequence
  SiRNA target sequence
ctcatagaaagcatttcttttgcta

SEQ ID NO: 248648 - DNA, 25 bp, Artificial sequence
  SiRNA target sequence
tcatagaaagcatttcttttgctaa

SEQ ID NO: 248649 - DNA, 25 bp, Artificial sequence
  SiRNA target sequence
catagaaagcatttcttttgctaaa

SEQ ID NO: 248650 - DNA, 25 bp, Artificial sequence
  SiRNA target sequence
atagaaagcatttcttttgctaaat

SEQ ID NO: 248651 - DNA, 25 bp, Artificial sequence
  SiRNA target sequence
tagaaagcatttcttttgctaaatc

SEQ ID NO: 248652 - DNA, 25 bp, Artificial sequence
  SiRNA target sequence
agaaagcatttcttttgctaaatca

SEQ ID NO: 248653 - DNA, 25 bp, Artificial sequence
  SiRNA target sequence
gaaagcatttcttttgctaaatcaa

SEQ ID NO: 248654 - DNA, 25 bp, Artificial sequence
  SiRNA target sequence
aaagcatttcttttgctaaatcaaa

SEQ ID NO: 248655 - DNA, 25 bp, Artificial sequence
  SiRNA target sequence
aagcatttcttttgctaaatcaaat

SEQ ID NO: 248656 - DNA, 25 bp, Artificial sequence
  SiRNA target sequence
agcatttcttttgctaaatcaaata

SEQ ID NO: 248657 - DNA, 25 bp, Artificial sequence
  SiRNA target sequence
gcatttcttttgctaaatcaaataa

SEQ ID NO: 248658 - DNA, 25 bp, Artificial sequence
  SiRNA target sequence
catttcttttgctaaatcaaataaa

SEQ ID NO: 248659 - DNA, 25 bp, Artificial sequence
  SiRNA target sequence
atttcttttgctaaatcaaataaaa

SEQ ID NO: 248660 - DNA, 25 bp, Artificial sequence
  SiRNA target sequence
tttcttttgctaaatcaaataaaac

SEQ ID NO: 248661 - DNA, 25 bp, Artificial sequence
  SiRNA target sequence
ttcttttgctaaatcaaataaaaca

SEQ ID NO: 248662 - DNA, 25 bp, Artificial sequence
  SiRNA target sequence
tcttttgctaaatcaaataaaacat

SEQ ID NO: 248663 - DNA, 25 bp, Artificial sequence
  SiRNA target sequence
cttttgctaaatcaaataaaacata

SEQ ID NO: 248664 - DNA, 25 bp, Artificial sequence
  SiRNA target sequence
ttttgctaaatcaaataaaacatat

SEQ ID NO: 248665 - DNA, 25 bp, Artificial sequence
  SiRNA target sequence
tttgctaaatcaaataaaacatatt

SEQ ID NO: 248666 - DNA, 25 bp, Artificial sequence
  SiRNA target sequence
ttgctaaatcaaataaaacatattt

SEQ ID NO: 248667 - DNA, 25 bp, Artificial sequence
  SiRNA target sequence
tgctaaatcaaataaaacatatttg

SEQ ID NO: 248668 - DNA, 25 bp, Artificial sequence
  SiRNA target sequence
gctaaatcaaataaaacatatttgg

SEQ ID NO: 248669 - DNA, 25 bp, Artificial sequence
  SiRNA target sequence
ctaaatcaaataaaacatatttggt

SEQ ID NO: 248670 - DNA, 25 bp, Artificial sequence
  SiRNA target sequence
taaatcaaataaaacatatttggta

SEQ ID NO: 248671 - DNA, 25 bp, Artificial sequence
  SiRNA target sequence
aaatcaaataaaacatatttggtaa

SEQ ID NO: 248672 - DNA, 25 bp, Artificial sequence
  SiRNA target sequence
aatcaaataaaacatatttggtaat

SEQ ID NO: 248673 - DNA, 25 bp, Artificial sequence
  SiRNA target sequence
atcaaataaaacatatttggtaatt

SEQ ID NO: 248674 - DNA, 25 bp, Artificial sequence
  SiRNA target sequence
tcaaataaaacatatttggtaattt

SEQ ID NO: 248675 - DNA, 25 bp, Artificial sequence
  SiRNA target sequence
caaataaaacatatttggtaatttt

SEQ ID NO: 248676 - DNA, 25 bp, Artificial sequence
  SiRNA target sequence
aaataaaacatatttggtaatttta

SEQ ID NO: 248677 - DNA, 25 bp, Artificial sequence
  SiRNA target sequence
aataaaacatatttggtaattttag

SEQ ID NO: 248678 - DNA, 25 bp, Artificial sequence
  SiRNA target sequence
ataaaacatatttggtaattttaga

SEQ ID NO: 248679 - DNA, 25 bp, Artificial sequence
  SiRNA target sequence
taaaacatatttggtaattttagaa

SEQ ID NO: 248680 - DNA, 25 bp, Artificial sequence
  SiRNA target sequence
aaaacatatttggtaattttagaaa

SEQ ID NO: 248681 - DNA, 25 bp, Artificial sequence
  SiRNA target sequence
aaacatatttggtaattttagaaaa

SEQ ID NO: 248682 - DNA, 25 bp, Artificial sequence
  SiRNA target sequence
aacatatttggtaattttagaaaat

SEQ ID NO: 248683 - DNA, 25 bp, Artificial sequence
  SiRNA target sequence
acatatttggtaattttagaaaatg

SEQ ID NO: 248684 - DNA, 25 bp, Artificial sequence
  SiRNA target sequence
catatttggtaattttagaaaatgc

SEQ ID NO: 248685 - DNA, 25 bp, Artificial sequence
  SiRNA target sequence
atatttggtaattttagaaaatgca

SEQ ID NO: 248686 - DNA, 25 bp, Artificial sequence
  SiRNA target sequence
tatttggtaattttagaaaatgcaa

SEQ ID NO: 248687 - DNA, 25 bp, Artificial sequence
  SiRNA target sequence
atttggtaattttagaaaatgcaaa

SEQ ID NO: 248688 - DNA, 25 bp, Artificial sequence
  SiRNA target sequence
tttggtaattttagaaaatgcaaat

SEQ ID NO: 248689 - DNA, 25 bp, Artificial sequence
  SiRNA target sequence
ttggtaattttagaaaatgcaaatc

SEQ ID NO: 248690 - DNA, 25 bp, Artificial sequence
  SiRNA target sequence
tggtaattttagaaaatgcaaatcc

SEQ ID NO: 248691 - DNA, 25 bp, Artificial sequence
  SiRNA target sequence
ggtaattttagaaaatgcaaatcca

SEQ ID NO: 248692 - DNA, 25 bp, Artificial sequence
  SiRNA target sequence
gtaattttagaaaatgcaaatccaa

SEQ ID NO: 248693 - DNA, 25 bp, Artificial sequence
  SiRNA target sequence
taattttagaaaatgcaaatccaat

SEQ ID NO: 248694 - DNA, 25 bp, Artificial sequence
  SiRNA target sequence
aattttagaaaatgcaaatccaatg

SEQ ID NO: 248695 - DNA, 25 bp, Artificial sequence
  SiRNA target sequence
attttagaaaatgcaaatccaatgg

SEQ ID NO: 248696 - DNA, 25 bp, Artificial sequence
  SiRNA target sequence
ttttagaaaatgcaaatccaatggt

SEQ ID NO: 248697 - DNA, 25 bp, Artificial sequence
  SiRNA target sequence
tttagaaaatgcaaatccaatggtt

SEQ ID NO: 248698 - DNA, 25 bp, Artificial sequence
  SiRNA target sequence
ttagaaaatgcaaatccaatggttg

SEQ ID NO: 248699 - DNA, 25 bp, Artificial sequence
  SiRNA target sequence
tagaaaatgcaaatccaatggttgc

SEQ ID NO: 248700 - DNA, 25 bp, Artificial sequence
  SiRNA target sequence
agaaaatgcaaatccaatggttgca

SEQ ID NO: 248701 - DNA, 25 bp, Artificial sequence
  SiRNA target sequence
gaaaatgcaaatccaatggttgcac

SEQ ID NO: 248702 - DNA, 25 bp, Artificial sequence
  SiRNA target sequence
aaaatgcaaatccaatggttgcaca

SEQ ID NO: 248703 - DNA, 25 bp, Artificial sequence
  SiRNA target sequence
aaatgcaaatccaatggttgcacac

SEQ ID NO: 248704 - DNA, 25 bp, Artificial sequence
  SiRNA target sequence
aatgcaaatccaatggttgcacacc

SEQ ID NO: 248705 - DNA, 25 bp, Artificial sequence
  SiRNA target sequence
atgcaaatccaatggttgcacacca

SEQ ID NO: 248706 - DNA, 25 bp, Artificial sequence
  SiRNA target sequence
tgcaaatccaatggttgcacaccaa

SEQ ID NO: 248707 - DNA, 25 bp, Artificial sequence
  SiRNA target sequence
gcaaatccaatggttgcacaccaat

SEQ ID NO: 248708 - DNA, 25 bp, Artificial sequence
  SiRNA target sequence
caaatccaatggttgcacaccaatt

SEQ ID NO: 248709 - DNA, 25 bp, Artificial sequence
  SiRNA target sequence
aaatccaatggttgcacaccaattt

SEQ ID NO: 248710 - DNA, 25 bp, Artificial sequence
  SiRNA target sequence
aatccaatggttgcacaccaatttt

SEQ ID NO: 248711 - DNA, 25 bp, Artificial sequence
  SiRNA target sequence
atccaatggttgcacaccaattttc

SEQ ID NO: 248712 - DNA, 25 bp, Artificial sequence
  SiRNA target sequence
tccaatggttgcacaccaattttca

SEQ ID NO: 248713 - DNA, 25 bp, Artificial sequence
  SiRNA target sequence
ccaatggttgcacaccaattttcaa

SEQ ID NO: 248714 - DNA, 25 bp, Artificial sequence
  SiRNA target sequence
caatggttgcacaccaattttcaag

SEQ ID NO: 248715 - DNA, 25 bp, Artificial sequence
  SiRNA target sequence
aatggttgcacaccaattttcaaga

SEQ ID NO: 248716 - DNA, 25 bp, Artificial sequence
  SiRNA target sequence
atggttgcacaccaattttcaagat

SEQ ID NO: 248717 - DNA, 25 bp, Artificial sequence
  SiRNA target sequence
tggttgcacaccaattttcaagatt

SEQ ID NO: 248718 - DNA, 25 bp, Artificial sequence
  SiRNA target sequence
ggttgcacaccaattttcaagattt

SEQ ID NO: 248719 - DNA, 25 bp, Artificial sequence
  SiRNA target sequence
gttgcacaccaattttcaagattta

SEQ ID NO: 248720 - DNA, 25 bp, Artificial sequence
  SiRNA target sequence
ttgcacaccaattttcaagatttat

SEQ ID NO: 248721 - DNA, 25 bp, Artificial sequence
  SiRNA target sequence
tgcacaccaattttcaagatttatt

SEQ ID NO: 248722 - DNA, 25 bp, Artificial sequence
  SiRNA target sequence
gcacaccaattttcaagatttattc

SEQ ID NO: 248723 - DNA, 25 bp, Artificial sequence
  SiRNA target sequence
cacaccaattttcaagatttattct

SEQ ID NO: 248724 - DNA, 25 bp, Artificial sequence
  SiRNA target sequence
acaccaattttcaagatttattctt

SEQ ID NO: 248725 - DNA, 25 bp, Artificial sequence
  SiRNA target sequence
caccaattttcaagatttattctta

SEQ ID NO: 248726 - DNA, 25 bp, Artificial sequence
  SiRNA target sequence
accaattttcaagatttattcttaa

SEQ ID NO: 248727 - DNA, 25 bp, Artificial sequence
  SiRNA target sequence
ccaattttcaagatttattcttaag

SEQ ID NO: 248728 - DNA, 25 bp, Artificial sequence
  SiRNA target sequence
caattttcaagatttattcttaaga

SEQ ID NO: 248729 - DNA, 25 bp, Artificial sequence
  SiRNA target sequence
aattttcaagatttattcttaagac

SEQ ID NO: 248730 - DNA, 25 bp, Artificial sequence
  SiRNA target sequence
attttcaagatttattcttaagacc

SEQ ID NO: 248731 - DNA, 25 bp, Artificial sequence
  SiRNA target sequence
ttttcaagatttattcttaagaccg

SEQ ID NO: 248732 - DNA, 25 bp, Artificial sequence
  SiRNA target sequence
tttcaagatttattcttaagaccga

SEQ ID NO: 248733 - DNA, 25 bp, Artificial sequence
  SiRNA target sequence
ttcaagatttattcttaagaccgat

SEQ ID NO: 248734 - DNA, 25 bp, Artificial sequence
  SiRNA target sequence
tcaagatttattcttaagaccgatg

SEQ ID NO: 248735 - DNA, 25 bp, Artificial sequence
  SiRNA target sequence
caagatttattcttaagaccgatgg

SEQ ID NO: 248736 - DNA, 25 bp, Artificial sequence
  SiRNA target sequence
aagatttattcttaagaccgatgga

SEQ ID NO: 248737 - DNA, 25 bp, Artificial sequence
  SiRNA target sequence
agatttattcttaagaccgatggag

SEQ ID NO: 248738 - DNA, 25 bp, Artificial sequence
  SiRNA target sequence
gatttattcttaagaccgatggagc

SEQ ID NO: 248739 - DNA, 25 bp, Artificial sequence
  SiRNA target sequence
atttattcttaagaccgatggagct

SEQ ID NO: 248740 - DNA, 25 bp, Artificial sequence
  SiRNA target sequence
tttattcttaagaccgatggagctg

SEQ ID NO: 248741 - DNA, 25 bp, Artificial sequence
  SiRNA target sequence
ttattcttaagaccgatggagctgt

SEQ ID NO: 248742 - DNA, 25 bp, Artificial sequence
  SiRNA target sequence
tattcttaagaccgatggagctgtg

SEQ ID NO: 248743 - DNA, 25 bp, Artificial sequence
  SiRNA target sequence
attcttaagaccgatggagctgtgc

SEQ ID NO: 248744 - DNA, 25 bp, Artificial sequence
  SiRNA target sequence
ttcttaagaccgatggagctgtgcg

SEQ ID NO: 248745 - DNA, 25 bp, Artificial sequence
  SiRNA target sequence
tcttaagaccgatggagctgtgcgc

SEQ ID NO: 248746 - DNA, 25 bp, Artificial sequence
  SiRNA target sequence
cttaagaccgatggagctgtgcgca

SEQ ID NO: 248747 - DNA, 25 bp, Artificial sequence
  SiRNA target sequence
ttaagaccgatggagctgtgcgcaa

SEQ ID NO: 248748 - DNA, 25 bp, Artificial sequence
  SiRNA target sequence
taagaccgatggagctgtgcgcaaa

SEQ ID NO: 248749 - DNA, 25 bp, Artificial sequence
  SiRNA target sequence
aagaccgatggagctgtgcgcaaat

SEQ ID NO: 248750 - DNA, 25 bp, Artificial sequence
  SiRNA target sequence
agaccgatggagctgtgcgcaaatt

SEQ ID NO: 248751 - DNA, 25 bp, Artificial sequence
  SiRNA target sequence
gaccgatggagctgtgcgcaaattg

SEQ ID NO: 248752 - DNA, 25 bp, Artificial sequence
  SiRNA target sequence
accgatggagctgtgcgcaaattgt

SEQ ID NO: 248753 - DNA, 25 bp, Artificial sequence
  SiRNA target sequence
ccgatggagctgtgcgcaaattgta

SEQ ID NO: 248754 - DNA, 25 bp, Artificial sequence
  SiRNA target sequence
cgatggagctgtgcgcaaattgtaa

SEQ ID NO: 248755 - DNA, 25 bp, Artificial sequence
  SiRNA target sequence
gatggagctgtgcgcaaattgtaaa

SEQ ID NO: 248756 - DNA, 25 bp, Artificial sequence
  SiRNA target sequence
atggagctgtgcgcaaattgtaaaa

SEQ ID NO: 248757 - DNA, 25 bp, Artificial sequence
  SiRNA target sequence
tggagctgtgcgcaaattgtaaaaa

SEQ ID NO: 248758 - DNA, 25 bp, Artificial sequence
  SiRNA target sequence
ggagctgtgcgcaaattgtaaaaag

SEQ ID NO: 248759 - DNA, 25 bp, Artificial sequence
  SiRNA target sequence
gagctgtgcgcaaattgtaaaaaga

SEQ ID NO: 248760 - DNA, 25 bp, Artificial sequence
  SiRNA target sequence
agctgtgcgcaaattgtaaaaagaa

SEQ ID NO: 248761 - DNA, 25 bp, Artificial sequence
  SiRNA target sequence
gctgtgcgcaaattgtaaaaagaaa

SEQ ID NO: 248762 - DNA, 25 bp, Artificial sequence
  SiRNA target sequence
ctgtgcgcaaattgtaaaaagaaag

SEQ ID NO: 248763 - DNA, 25 bp, Artificial sequence
  SiRNA target sequence
tgtgcgcaaattgtaaaaagaaagt

SEQ ID NO: 248764 - DNA, 25 bp, Artificial sequence
  SiRNA target sequence
gtgcgcaaattgtaaaaagaaagtc

SEQ ID NO: 248765 - DNA, 25 bp, Artificial sequence
  SiRNA target sequence
tgcgcaaattgtaaaaagaaagtcc

SEQ ID NO: 248766 - DNA, 25 bp, Artificial sequence
  SiRNA target sequence
gcgcaaattgtaaaaagaaagtcct

SEQ ID NO: 248767 - DNA, 25 bp, Artificial sequence
  SiRNA target sequence
cgcaaattgtaaaaagaaagtcctg

SEQ ID NO: 248768 - DNA, 25 bp, Artificial sequence
  SiRNA target sequence
gcaaattgtaaaaagaaagtcctga

SEQ ID NO: 248769 - DNA, 25 bp, Artificial sequence
  SiRNA target sequence
caaattgtaaaaagaaagtcctgaa

SEQ ID NO: 248770 - DNA, 25 bp, Artificial sequence
  SiRNA target sequence
aaattgtaaaaagaaagtcctgaaa

SEQ ID NO: 248771 - DNA, 25 bp, Artificial sequence
  SiRNA target sequence
aattgtaaaaagaaagtcctgaaat

SEQ ID NO: 248772 - DNA, 25 bp, Artificial sequence
  SiRNA target sequence
attgtaaaaagaaagtcctgaaatt

SEQ ID NO: 248773 - DNA, 25 bp, Artificial sequence
  SiRNA target sequence
ttgtaaaaagaaagtcctgaaatta

SEQ ID NO: 248774 - DNA, 25 bp, Artificial sequence
  SiRNA target sequence
tgtaaaaagaaagtcctgaaattag

SEQ ID NO: 248775 - DNA, 25 bp, Artificial sequence
  SiRNA target sequence
gtaaaaagaaagtcctgaaattaga

SEQ ID NO: 248776 - DNA, 25 bp, Artificial sequence
  SiRNA target sequence
taaaaagaaagtcctgaaattagag

SEQ ID NO: 248777 - DNA, 25 bp, Artificial sequence
  SiRNA target sequence
aaaaagaaagtcctgaaattagagc

SEQ ID NO: 248778 - DNA, 25 bp, Artificial sequence
  SiRNA target sequence
aaaagaaagtcctgaaattagagcg

SEQ ID NO: 248779 - DNA, 25 bp, Artificial sequence
  SiRNA target sequence
aaagaaagtcctgaaattagagcgg

SEQ ID NO: 248780 - DNA, 25 bp, Artificial sequence
  SiRNA target sequence
aagaaagtcctgaaattagagcggt

SEQ ID NO: 248781 - DNA, 25 bp, Artificial sequence
  SiRNA target sequence
agaaagtcctgaaattagagcggta

SEQ ID NO: 248782 - DNA, 25 bp, Artificial sequence
  SiRNA target sequence
gaaagtcctgaaattagagcggtaa

SEQ ID NO: 248783 - DNA, 25 bp, Artificial sequence
  SiRNA target sequence
aaagtcctgaaattagagcggtaaa

SEQ ID NO: 248784 - DNA, 25 bp, Artificial sequence
  SiRNA target sequence
aagtcctgaaattagagcggtaaaa

SEQ ID NO: 248785 - DNA, 25 bp, Artificial sequence
  SiRNA target sequence
agtcctgaaattagagcggtaaaaa

SEQ ID NO: 248786 - DNA, 25 bp, Artificial sequence
  SiRNA target sequence
gtcctgaaattagagcggtaaaaaa

SEQ ID NO: 248787 - DNA, 25 bp, Artificial sequence
  SiRNA target sequence
tcctgaaattagagcggtaaaaaat

SEQ ID NO: 248788 - DNA, 25 bp, Artificial sequence
  SiRNA target sequence
cctgaaattagagcggtaaaaaata

SEQ ID NO: 248789 - DNA, 25 bp, Artificial sequence
  SiRNA target sequence
ctgaaattagagcggtaaaaaatat

SEQ ID NO: 248790 - DNA, 25 bp, Artificial sequence
  SiRNA target sequence
tgaaattagagcggtaaaaaatata

SEQ ID NO: 248791 - DNA, 25 bp, Artificial sequence
  SiRNA target sequence
gaaattagagcggtaaaaaatatag

SEQ ID NO: 248792 - DNA, 25 bp, Artificial sequence
  SiRNA target sequence
aaattagagcggtaaaaaatatagc

SEQ ID NO: 248793 - DNA, 25 bp, Artificial sequence
  SiRNA target sequence
aattagagcggtaaaaaatatagca

SEQ ID NO: 248794 - DNA, 25 bp, Artificial sequence
  SiRNA target sequence
attagagcggtaaaaaatatagcag

SEQ ID NO: 248795 - DNA, 25 bp, Artificial sequence
  SiRNA target sequence
ttagagcggtaaaaaatatagcagc

SEQ ID NO: 248796 - DNA, 25 bp, Artificial sequence
  SiRNA target sequence
tagagcggtaaaaaatatagcagca

SEQ ID NO: 248797 - DNA, 25 bp, Artificial sequence
  SiRNA target sequence
agagcggtaaaaaatatagcagcaa

SEQ ID NO: 248798 - DNA, 25 bp, Artificial sequence
  SiRNA target sequence
gagcggtaaaaaatatagcagcaat

SEQ ID NO: 248799 - DNA, 25 bp, Artificial sequence
  SiRNA target sequence
agcggtaaaaaatatagcagcaata

SEQ ID NO: 248800 - DNA, 25 bp, Artificial sequence
  SiRNA target sequence
gcggtaaaaaatatagcagcaatag

SEQ ID NO: 248801 - DNA, 25 bp, Artificial sequence
  SiRNA target sequence
cggtaaaaaatatagcagcaatagg

SEQ ID NO: 248802 - DNA, 25 bp, Artificial sequence
  SiRNA target sequence
ggtaaaaaatatagcagcaataggg

SEQ ID NO: 248803 - DNA, 25 bp, Artificial sequence
  SiRNA target sequence
gtaaaaaatatagcagcaatagggg

SEQ ID NO: 248804 - DNA, 25 bp, Artificial sequence
  SiRNA target sequence
taaaaaatatagcagcaatagggga

SEQ ID NO: 248805 - DNA, 25 bp, Artificial sequence
  SiRNA target sequence
aaaaaatatagcagcaataggggag

SEQ ID NO: 248806 - DNA, 25 bp, Artificial sequence
  SiRNA target sequence
aaaaatatagcagcaataggggagg

SEQ ID NO: 248807 - DNA, 25 bp, Artificial sequence
  SiRNA target sequence
aaaatatagcagcaataggggaggc

SEQ ID NO: 248808 - DNA, 25 bp, Artificial sequence
  SiRNA target sequence
aaatatagcagcaataggggaggca

SEQ ID NO: 248809 - DNA, 25 bp, Artificial sequence
  SiRNA target sequence
aatatagcagcaataggggaggcaa

SEQ ID NO: 248810 - DNA, 25 bp, Artificial sequence
  SiRNA target sequence
atatagcagcaataggggaggcaat

SEQ ID NO: 248811 - DNA, 25 bp, Artificial sequence
  SiRNA target sequence
tatagcagcaataggggaggcaata

SEQ ID NO: 248812 - DNA, 25 bp, Artificial sequence
  SiRNA target sequence
atagcagcaataggggaggcaatag

SEQ ID NO: 248813 - DNA, 25 bp, Artificial sequence
  SiRNA target sequence
tagcagcaataggggaggcaataga

SEQ ID NO: 248814 - DNA, 25 bp, Artificial sequence
  SiRNA target sequence
agcagcaataggggaggcaatagat

SEQ ID NO: 248815 - DNA, 25 bp, Artificial sequence
  SiRNA target sequence
gcagcaataggggaggcaatagata

SEQ ID NO: 248816 - DNA, 25 bp, Artificial sequence
  SiRNA target sequence
cagcaataggggaggcaatagatag

SEQ ID NO: 248817 - DNA, 25 bp, Artificial sequence
  SiRNA target sequence
agcaataggggaggcaatagataga

SEQ ID NO: 248818 - DNA, 25 bp, Artificial sequence
  SiRNA target sequence
gcaataggggaggcaatagatagat

SEQ ID NO: 248819 - DNA, 25 bp, Artificial sequence
  SiRNA target sequence
caataggggaggcaatagatagata

SEQ ID NO: 248820 - DNA, 25 bp, Artificial sequence
  SiRNA target sequence
aataggggaggcaatagatagataa

SEQ ID NO: 248821 - DNA, 25 bp, Artificial sequence
  SiRNA target sequence
ataggggaggcaatagatagataaa

SEQ ID NO: 248822 - DNA, 25 bp, Artificial sequence
  SiRNA target sequence
taggggaggcaatagatagataaaa

SEQ ID NO: 248823 - DNA, 25 bp, Artificial sequence
  SiRNA target sequence
aggggaggcaatagatagataaaag

SEQ ID NO: 248824 - DNA, 25 bp, Artificial sequence
  SiRNA target sequence
ggggaggcaatagatagataaaaga

SEQ ID NO: 248825 - DNA, 25 bp, Artificial sequence
  SiRNA target sequence
gggaggcaatagatagataaaagat

SEQ ID NO: 248826 - DNA, 25 bp, Artificial sequence
  SiRNA target sequence
ggaggcaatagatagataaaagatc

SEQ ID NO: 248827 - DNA, 25 bp, Artificial sequence
  SiRNA target sequence
gaggcaatagatagataaaagatcc

SEQ ID NO: 248828 - DNA, 25 bp, Artificial sequence
  SiRNA target sequence
aggcaatagatagataaaagatcct

SEQ ID NO: 248829 - DNA, 25 bp, Artificial sequence
  SiRNA target sequence
ggcaatagatagataaaagatcctt

SEQ ID NO: 248830 - DNA, 25 bp, Artificial sequence
  SiRNA target sequence
gcaatagatagataaaagatccttg

SEQ ID NO: 248831 - DNA, 25 bp, Artificial sequence
  SiRNA target sequence
caatagatagataaaagatccttga

SEQ ID NO: 248832 - DNA, 25 bp, Artificial sequence
  SiRNA target sequence
aatagatagataaaagatccttgat

SEQ ID NO: 248833 - DNA, 25 bp, Artificial sequence
  SiRNA target sequence
atagatagataaaagatccttgatg

SEQ ID NO: 248834 - DNA, 25 bp, Artificial sequence
  SiRNA target sequence
tagatagataaaagatccttgatgc

SEQ ID NO: 248835 - DNA, 25 bp, Artificial sequence
  SiRNA target sequence
agatagataaaagatccttgatgca

SEQ ID NO: 248836 - DNA, 25 bp, Artificial sequence
  SiRNA target sequence
gatagataaaagatccttgatgcaa

SEQ ID NO: 248837 - DNA, 25 bp, Artificial sequence
  SiRNA target sequence
atagataaaagatccttgatgcaat

SEQ ID NO: 248838 - DNA, 25 bp, Artificial sequence
  SiRNA target sequence
tagataaaagatccttgatgcaatg

SEQ ID NO: 248839 - DNA, 25 bp, Artificial sequence
  SiRNA target sequence
agataaaagatccttgatgcaatgc

SEQ ID NO: 248840 - DNA, 25 bp, Artificial sequence
  SiRNA target sequence
gataaaagatccttgatgcaatgcg

SEQ ID NO: 248841 - DNA, 25 bp, Artificial sequence
  SiRNA target sequence
ataaaagatccttgatgcaatgcga

SEQ ID NO: 248842 - DNA, 25 bp, Artificial sequence
  SiRNA target sequence
taaaagatccttgatgcaatgcgat

SEQ ID NO: 248843 - DNA, 25 bp, Artificial sequence
  SiRNA target sequence
aaaagatccttgatgcaatgcgatt

SEQ ID NO: 248844 - DNA, 25 bp, Artificial sequence
  SiRNA target sequence
aaagatccttgatgcaatgcgattt

SEQ ID NO: 248845 - DNA, 25 bp, Artificial sequence
  SiRNA target sequence
aagatccttgatgcaatgcgatttc

SEQ ID NO: 248846 - DNA, 25 bp, Artificial sequence
  SiRNA target sequence
agatccttgatgcaatgcgatttcc

SEQ ID NO: 248847 - DNA, 25 bp, Artificial sequence
  SiRNA target sequence
gatccttgatgcaatgcgatttcca

SEQ ID NO: 248848 - DNA, 25 bp, Artificial sequence
  SiRNA target sequence
atccttgatgcaatgcgatttccac

SEQ ID NO: 248849 - DNA, 25 bp, Artificial sequence
  SiRNA target sequence
tccttgatgcaatgcgatttccacg

SEQ ID NO: 248850 - DNA, 25 bp, Artificial sequence
  SiRNA target sequence
ccttgatgcaatgcgatttccacgg

SEQ ID NO: 248851 - DNA, 25 bp, Artificial sequence
  SiRNA target sequence
cttgatgcaatgcgatttccacgga

SEQ ID NO: 248852 - DNA, 25 bp, Artificial sequence
  SiRNA target sequence
ttgatgcaatgcgatttccacggat

SEQ ID NO: 248853 - DNA, 25 bp, Artificial sequence
  SiRNA target sequence
tgatgcaatgcgatttccacggatt

SEQ ID NO: 248854 - DNA, 25 bp, Artificial sequence
  SiRNA target sequence
gatgcaatgcgatttccacggatta

SEQ ID NO: 248855 - DNA, 25 bp, Artificial sequence
  SiRNA target sequence
atgcaatgcgatttccacggattac

SEQ ID NO: 248856 - DNA, 25 bp, Artificial sequence
  SiRNA target sequence
tgcaatgcgatttccacggattaca

SEQ ID NO: 248857 - DNA, 25 bp, Artificial sequence
  SiRNA target sequence
gcaatgcgatttccacggattacaa

SEQ ID NO: 248858 - DNA, 25 bp, Artificial sequence
  SiRNA target sequence
caatgcgatttccacggattacaaa

SEQ ID NO: 248859 - DNA, 25 bp, Artificial sequence
  SiRNA target sequence
aatgcgatttccacggattacaaag

SEQ ID NO: 248860 - DNA, 25 bp, Artificial sequence
  SiRNA target sequence
atgcgatttccacggattacaaagt

SEQ ID NO: 248861 - DNA, 25 bp, Artificial sequence
  SiRNA target sequence
tgcgatttccacggattacaaagtt

SEQ ID NO: 248862 - DNA, 25 bp, Artificial sequence
  SiRNA target sequence
gcgatttccacggattacaaagtta

SEQ ID NO: 248863 - DNA, 25 bp, Artificial sequence
  SiRNA target sequence
cgatttccacggattacaaagttat

SEQ ID NO: 248864 - DNA, 25 bp, Artificial sequence
  SiRNA target sequence
gatttccacggattacaaagttata

SEQ ID NO: 248865 - DNA, 25 bp, Artificial sequence
  SiRNA target sequence
atttccacggattacaaagttataa

SEQ ID NO: 248866 - DNA, 25 bp, Artificial sequence
  SiRNA target sequence
tttccacggattacaaagttataaa

SEQ ID NO: 248867 - DNA, 25 bp, Artificial sequence
  SiRNA target sequence
ttccacggattacaaagttataaaa

SEQ ID NO: 248868 - DNA, 25 bp, Artificial sequence
  SiRNA target sequence
tccacggattacaaagttataaaat

SEQ ID NO: 248869 - DNA, 25 bp, Artificial sequence
  SiRNA target sequence
ccacggattacaaagttataaaata

SEQ ID NO: 248870 - DNA, 25 bp, Artificial sequence
  SiRNA target sequence
cacggattacaaagttataaaataa

SEQ ID NO: 248871 - DNA, 25 bp, Artificial sequence
  SiRNA target sequence
acggattacaaagttataaaataat

SEQ ID NO: 248872 - DNA, 25 bp, Artificial sequence
  SiRNA target sequence
cggattacaaagttataaaataatg

SEQ ID NO: 248873 - DNA, 25 bp, Artificial sequence
  SiRNA target sequence
ggattacaaagttataaaataatga

SEQ ID NO: 248874 - DNA, 25 bp, Artificial sequence
  SiRNA target sequence
gattacaaagttataaaataatgat

SEQ ID NO: 248875 - DNA, 25 bp, Artificial sequence
  SiRNA target sequence
attacaaagttataaaataatgata

SEQ ID NO: 248876 - DNA, 25 bp, Artificial sequence
  SiRNA target sequence
ttacaaagttataaaataatgatac

SEQ ID NO: 248877 - DNA, 25 bp, Artificial sequence
  SiRNA target sequence
tacaaagttataaaataatgataca

SEQ ID NO: 248878 - DNA, 25 bp, Artificial sequence
  SiRNA target sequence
acaaagttataaaataatgatacag

SEQ ID NO: 248879 - DNA, 25 bp, Artificial sequence
  SiRNA target sequence
caaagttataaaataatgatacagc

SEQ ID NO: 248880 - DNA, 25 bp, Artificial sequence
  SiRNA target sequence
aaagttataaaataatgatacagca

SEQ ID NO: 248881 - DNA, 25 bp, Artificial sequence
  SiRNA target sequence
aagttataaaataatgatacagcac

SEQ ID NO: 248882 - DNA, 25 bp, Artificial sequence
  SiRNA target sequence
agttataaaataatgatacagcact

SEQ ID NO: 248883 - DNA, 25 bp, Artificial sequence
  SiRNA target sequence
gttataaaataatgatacagcacta

SEQ ID NO: 248884 - DNA, 25 bp, Artificial sequence
  SiRNA target sequence
ttataaaataatgatacagcactaa

SEQ ID NO: 248885 - DNA, 25 bp, Artificial sequence
  SiRNA target sequence
tataaaataatgatacagcactaat

SEQ ID NO: 248886 - DNA, 25 bp, Artificial sequence
  SiRNA target sequence
ataaaataatgatacagcactaatc

SEQ ID NO: 248887 - DNA, 25 bp, Artificial sequence
  SiRNA target sequence
taaaataatgatacagcactaatcg

SEQ ID NO: 248888 - DNA, 25 bp, Artificial sequence
  SiRNA target sequence
aaaataatgatacagcactaatcgt

SEQ ID NO: 248889 - DNA, 25 bp, Artificial sequence
  SiRNA target sequence
aaataatgatacagcactaatcgtt

SEQ ID NO: 248890 - DNA, 25 bp, Artificial sequence
  SiRNA target sequence
aataatgatacagcactaatcgtta

SEQ ID NO: 248891 - DNA, 25 bp, Artificial sequence
  SiRNA target sequence
ataatgatacagcactaatcgttaa

SEQ ID NO: 248892 - DNA, 25 bp, Artificial sequence
  SiRNA target sequence
taatgatacagcactaatcgttaag

SEQ ID NO: 248893 - DNA, 25 bp, Artificial sequence
  SiRNA target sequence
aatgatacagcactaatcgttaagg

SEQ ID NO: 248894 - DNA, 25 bp, Artificial sequence
  SiRNA target sequence
atgatacagcactaatcgttaagga

SEQ ID NO: 248895 - DNA, 25 bp, Artificial sequence
  SiRNA target sequence
tgatacagcactaatcgttaaggaa

SEQ ID NO: 248896 - DNA, 25 bp, Artificial sequence
  SiRNA target sequence
gatacagcactaatcgttaaggaag

SEQ ID NO: 248897 - DNA, 25 bp, Artificial sequence
  SiRNA target sequence
atacagcactaatcgttaaggaagt

SEQ ID NO: 248898 - DNA, 25 bp, Artificial sequence
  SiRNA target sequence
tacagcactaatcgttaaggaagtt

SEQ ID NO: 248899 - DNA, 25 bp, Artificial sequence
  SiRNA target sequence
acagcactaatcgttaaggaagttg

SEQ ID NO: 248900 - DNA, 25 bp, Artificial sequence
  SiRNA target sequence
cagcactaatcgttaaggaagttgt

SEQ ID NO: 248901 - DNA, 25 bp, Artificial sequence
  SiRNA target sequence
agcactaatcgttaaggaagttgtt

SEQ ID NO: 248902 - DNA, 25 bp, Artificial sequence
  SiRNA target sequence
gcactaatcgttaaggaagttgtta

SEQ ID NO: 248903 - DNA, 25 bp, Artificial sequence
  SiRNA target sequence
cactaatcgttaaggaagttgttac

SEQ ID NO: 248904 - DNA, 25 bp, Artificial sequence
  SiRNA target sequence
actaatcgttaaggaagttgttact

SEQ ID NO: 248905 - DNA, 25 bp, Artificial sequence
  SiRNA target sequence
ctaatcgttaaggaagttgttacta

SEQ ID NO: 248906 - DNA, 25 bp, Artificial sequence
  SiRNA target sequence
taatcgttaaggaagttgttactaa

SEQ ID NO: 248907 - DNA, 25 bp, Artificial sequence
  SiRNA target sequence
aatcgttaaggaagttgttactaaa

SEQ ID NO: 248908 - DNA, 25 bp, Artificial sequence
  SiRNA target sequence
atcgttaaggaagttgttactaaat

SEQ ID NO: 248909 - DNA, 25 bp, Artificial sequence
  SiRNA target sequence
tcgttaaggaagttgttactaaata

SEQ ID NO: 248910 - DNA, 25 bp, Artificial sequence
  SiRNA target sequence
cgttaaggaagttgttactaaatat

SEQ ID NO: 248911 - DNA, 25 bp, Artificial sequence
  SiRNA target sequence
gttaaggaagttgttactaaatatt

SEQ ID NO: 248912 - DNA, 25 bp, Artificial sequence
  SiRNA target sequence
ttaaggaagttgttactaaatattt

SEQ ID NO: 248913 - DNA, 25 bp, Artificial sequence
  SiRNA target sequence
taaggaagttgttactaaatatttt

SEQ ID NO: 248914 - DNA, 25 bp, Artificial sequence
  SiRNA target sequence
aaggaagttgttactaaatattttt

SEQ ID NO: 248915 - DNA, 25 bp, Artificial sequence
  SiRNA target sequence
aggaagttgttactaaatatttttg

SEQ ID NO: 248916 - DNA, 25 bp, Artificial sequence
  SiRNA target sequence
ggaagttgttactaaatatttttga

SEQ ID NO: 248917 - DNA, 25 bp, Artificial sequence
  SiRNA target sequence
gaagttgttactaaatatttttgag

SEQ ID NO: 248918 - DNA, 25 bp, Artificial sequence
  SiRNA target sequence
aagttgttactaaatatttttgaga

SEQ ID NO: 248919 - DNA, 25 bp, Artificial sequence
  SiRNA target sequence
agttgttactaaatatttttgagaa

SEQ ID NO: 248920 - DNA, 25 bp, Artificial sequence
  SiRNA target sequence
gttgttactaaatatttttgagaat

SEQ ID NO: 248921 - DNA, 25 bp, Artificial sequence
  SiRNA target sequence
ttgttactaaatatttttgagaata

SEQ ID NO: 248922 - DNA, 25 bp, Artificial sequence
  SiRNA target sequence
tgttactaaatatttttgagaataa

SEQ ID NO: 248923 - DNA, 25 bp, Artificial sequence
  SiRNA target sequence
gttactaaatatttttgagaataat

SEQ ID NO: 248924 - DNA, 25 bp, Artificial sequence
  SiRNA target sequence
ttactaaatatttttgagaataatc

SEQ ID NO: 248925 - DNA, 25 bp, Artificial sequence
  SiRNA target sequence
tactaaatatttttgagaataatct

SEQ ID NO: 248926 - DNA, 25 bp, Artificial sequence
  SiRNA target sequence
actaaatatttttgagaataatctt

SEQ ID NO: 248927 - DNA, 25 bp, Artificial sequence
  SiRNA target sequence
ctaaatatttttgagaataatcttt

SEQ ID NO: 248928 - DNA, 25 bp, Artificial sequence
  SiRNA target sequence
taaatatttttgagaataatctttc

SEQ ID NO: 248929 - DNA, 25 bp, Artificial sequence
  SiRNA target sequence
aaatatttttgagaataatctttcg

SEQ ID NO: 248930 - DNA, 25 bp, Artificial sequence
  SiRNA target sequence
aatatttttgagaataatctttcgg

SEQ ID NO: 248931 - DNA, 25 bp, Artificial sequence
  SiRNA target sequence
atatttttgagaataatctttcgga

SEQ ID NO: 248932 - DNA, 25 bp, Artificial sequence
  SiRNA target sequence
tatttttgagaataatctttcggag

SEQ ID NO: 248933 - DNA, 25 bp, Artificial sequence
  SiRNA target sequence
atttttgagaataatctttcggagg

SEQ ID NO: 248934 - DNA, 25 bp, Artificial sequence
  SiRNA target sequence
tttttgagaataatctttcggaggc

SEQ ID NO: 248935 - DNA, 25 bp, Artificial sequence
  SiRNA target sequence
ttttgagaataatctttcggaggca

SEQ ID NO: 248936 - DNA, 25 bp, Artificial sequence
  SiRNA target sequence
tttgagaataatctttcggaggcat

SEQ ID NO: 248937 - DNA, 25 bp, Artificial sequence
  SiRNA target sequence
ttgagaataatctttcggaggcata

SEQ ID NO: 248938 - DNA, 25 bp, Artificial sequence
  SiRNA target sequence
tgagaataatctttcggaggcatat

SEQ ID NO: 248939 - DNA, 25 bp, Artificial sequence
  SiRNA target sequence
gagaataatctttcggaggcatatt

SEQ ID NO: 248940 - DNA, 25 bp, Artificial sequence
  SiRNA target sequence
agaataatctttcggaggcatatta

SEQ ID NO: 248941 - DNA, 25 bp, Artificial sequence
  SiRNA target sequence
gaataatctttcggaggcatattat

SEQ ID NO: 248942 - DNA, 25 bp, Artificial sequence
  SiRNA target sequence
aataatctttcggaggcatattatt

SEQ ID NO: 248943 - DNA, 25 bp, Artificial sequence
  SiRNA target sequence
ataatctttcggaggcatattatta

SEQ ID NO: 248944 - DNA, 25 bp, Artificial sequence
  SiRNA target sequence
taatctttcggaggcatattattaa

SEQ ID NO: 248945 - DNA, 25 bp, Artificial sequence
  SiRNA target sequence
aatctttcggaggcatattattaat

SEQ ID NO: 248946 - DNA, 25 bp, Artificial sequence
  SiRNA target sequence
atctttcggaggcatattattaatt

SEQ ID NO: 248947 - DNA, 25 bp, Artificial sequence
  SiRNA target sequence
tctttcggaggcatattattaattc

SEQ ID NO: 248948 - DNA, 25 bp, Artificial sequence
  SiRNA target sequence
ctttcggaggcatattattaattct

SEQ ID NO: 248949 - DNA, 25 bp, Artificial sequence
  SiRNA target sequence
tttcggaggcatattattaattctg

SEQ ID NO: 248950 - DNA, 25 bp, Artificial sequence
  SiRNA target sequence
ttcggaggcatattattaattctgc

SEQ ID NO: 248951 - DNA, 25 bp, Artificial sequence
  SiRNA target sequence
tcggaggcatattattaattctgct

SEQ ID NO: 248952 - DNA, 25 bp, Artificial sequence
  SiRNA target sequence
cggaggcatattattaattctgctt

SEQ ID NO: 248953 - DNA, 25 bp, Artificial sequence
  SiRNA target sequence
ggaggcatattattaattctgcttc

SEQ ID NO: 248954 - DNA, 25 bp, Artificial sequence
  SiRNA target sequence
gaggcatattattaattctgcttcc

SEQ ID NO: 248955 - DNA, 25 bp, Artificial sequence
  SiRNA target sequence
aggcatattattaattctgcttccc

SEQ ID NO: 248956 - DNA, 25 bp, Artificial sequence
  SiRNA target sequence
ggcatattattaattctgcttcccg

SEQ ID NO: 248957 - DNA, 25 bp, Artificial sequence
  SiRNA target sequence
gcatattattaattctgcttcccgt

SEQ ID NO: 248958 - DNA, 25 bp, Artificial sequence
  SiRNA target sequence
catattattaattctgcttcccgta

SEQ ID NO: 248959 - DNA, 25 bp, Artificial sequence
  SiRNA target sequence
atattattaattctgcttcccgtag

SEQ ID NO: 248960 - DNA, 25 bp, Artificial sequence
  SiRNA target sequence
tattattaattctgcttcccgtaga

SEQ ID NO: 248961 - DNA, 25 bp, Artificial sequence
  SiRNA target sequence
attattaattctgcttcccgtagat

SEQ ID NO: 248962 - DNA, 25 bp, Artificial sequence
  SiRNA target sequence
ttattaattctgcttcccgtagata

SEQ ID NO: 248963 - DNA, 25 bp, Artificial sequence
  SiRNA target sequence
tattaattctgcttcccgtagataa

SEQ ID NO: 248964 - DNA, 25 bp, Artificial sequence
  SiRNA target sequence
attaattctgcttcccgtagataaa

SEQ ID NO: 248965 - DNA, 25 bp, Artificial sequence
  SiRNA target sequence
ttaattctgcttcccgtagataaag

SEQ ID NO: 248966 - DNA, 25 bp, Artificial sequence
  SiRNA target sequence
taattctgcttcccgtagataaaga

SEQ ID NO: 248967 - DNA, 25 bp, Artificial sequence
  SiRNA target sequence
aattctgcttcccgtagataaagaa

SEQ ID NO: 248968 - DNA, 25 bp, Artificial sequence
  SiRNA target sequence
attctgcttcccgtagataaagaat

SEQ ID NO: 248969 - DNA, 25 bp, Artificial sequence
  SiRNA target sequence
ttctgcttcccgtagataaagaatt

SEQ ID NO: 248970 - DNA, 25 bp, Artificial sequence
  SiRNA target sequence
tctgcttcccgtagataaagaattt

SEQ ID NO: 248971 - DNA, 25 bp, Artificial sequence
  SiRNA target sequence
ctgcttcccgtagataaagaatttt

SEQ ID NO: 248972 - DNA, 25 bp, Artificial sequence
  SiRNA target sequence
tgcttcccgtagataaagaattttt

SEQ ID NO: 248973 - DNA, 25 bp, Artificial sequence
  SiRNA target sequence
gcttcccgtagataaagaatttttt

SEQ ID NO: 248974 - DNA, 25 bp, Artificial sequence
  SiRNA target sequence
cttcccgtagataaagaatttttta

SEQ ID NO: 248975 - DNA, 25 bp, Artificial sequence
  SiRNA target sequence
ttcccgtagataaagaattttttaa

SEQ ID NO: 248976 - DNA, 25 bp, Artificial sequence
  SiRNA target sequence
tcccgtagataaagaattttttaag

SEQ ID NO: 248977 - DNA, 25 bp, Artificial sequence
  SiRNA target sequence
cccgtagataaagaattttttaagg

SEQ ID NO: 248978 - DNA, 25 bp, Artificial sequence
  SiRNA target sequence
ccgtagataaagaattttttaagga

SEQ ID NO: 248979 - DNA, 25 bp, Artificial sequence
  SiRNA target sequence
cgtagataaagaattttttaaggac

SEQ ID NO: 248980 - DNA, 25 bp, Artificial sequence
  SiRNA target sequence
gtagataaagaattttttaaggaca

SEQ ID NO: 248981 - DNA, 25 bp, Artificial sequence
  SiRNA target sequence
tagataaagaattttttaaggacat

SEQ ID NO: 248982 - DNA, 25 bp, Artificial sequence
  SiRNA target sequence
agataaagaattttttaaggacata

SEQ ID NO: 248983 - DNA, 25 bp, Artificial sequence
  SiRNA target sequence
gataaagaattttttaaggacatat

SEQ ID NO: 248984 - DNA, 25 bp, Artificial sequence
  SiRNA target sequence
ataaagaattttttaaggacatatc

SEQ ID NO: 248985 - DNA, 25 bp, Artificial sequence
  SiRNA target sequence
taaagaattttttaaggacatatca

SEQ ID NO: 248986 - DNA, 25 bp, Artificial sequence
  SiRNA target sequence
aaagaattttttaaggacatatcaa

SEQ ID NO: 248987 - DNA, 25 bp, Artificial sequence
  SiRNA target sequence
aagaattttttaaggacatatcaat

SEQ ID NO: 248988 - DNA, 25 bp, Artificial sequence
  SiRNA target sequence
agaattttttaaggacatatcaata

SEQ ID NO: 248989 - DNA, 25 bp, Artificial sequence
  SiRNA target sequence
gaattttttaaggacatatcaataa

SEQ ID NO: 248990 - DNA, 25 bp, Artificial sequence
  SiRNA target sequence
aattttttaaggacatatcaataaa

SEQ ID NO: 248991 - DNA, 25 bp, Artificial sequence
  SiRNA target sequence
attttttaaggacatatcaataaat

SEQ ID NO: 248992 - DNA, 25 bp, Artificial sequence
  SiRNA target sequence
ttttttaaggacatatcaataaatc

SEQ ID NO: 248993 - DNA, 25 bp, Artificial sequence
  SiRNA target sequence
tttttaaggacatatcaataaatcc

SEQ ID NO: 248994 - DNA, 25 bp, Artificial sequence
  SiRNA target sequence
ttttaaggacatatcaataaatcct

SEQ ID NO: 248995 - DNA, 25 bp, Artificial sequence
  SiRNA target sequence
tttaaggacatatcaataaatcctg

SEQ ID NO: 248996 - DNA, 25 bp, Artificial sequence
  SiRNA target sequence
ttaaggacatatcaataaatcctgc

SEQ ID NO: 248997 - DNA, 25 bp, Artificial sequence
  SiRNA target sequence
taaggacatatcaataaatcctgca

SEQ ID NO: 248998 - DNA, 25 bp, Artificial sequence
  SiRNA target sequence
aaggacatatcaataaatcctgcat

SEQ ID NO: 248999 - DNA, 25 bp, Artificial sequence
  SiRNA target sequence
aggacatatcaataaatcctgcatt

SEQ ID NO: 249000 - DNA, 25 bp, Artificial sequence
  SiRNA target sequence
ggacatatcaataaatcctgcatta

SEQ ID NO: 249001 - DNA, 25 bp, Artificial sequence
  SiRNA target sequence
gacatatcaataaatcctgcattaa

SEQ ID NO: 249002 - DNA, 25 bp, Artificial sequence
  SiRNA target sequence
acatatcaataaatcctgcattaat

SEQ ID NO: 249003 - DNA, 25 bp, Artificial sequence
  SiRNA target sequence
catatcaataaatcctgcattaata

SEQ ID NO: 249004 - DNA, 25 bp, Artificial sequence
  SiRNA target sequence
atatcaataaatcctgcattaatag

SEQ ID NO: 249005 - DNA, 25 bp, Artificial sequence
  SiRNA target sequence
tatcaataaatcctgcattaatagc

SEQ ID NO: 249006 - DNA, 25 bp, Artificial sequence
  SiRNA target sequence
atcaataaatcctgcattaatagca

SEQ ID NO: 249007 - DNA, 25 bp, Artificial sequence
  SiRNA target sequence
tcaataaatcctgcattaatagcat

SEQ ID NO: 249008 - DNA, 25 bp, Artificial sequence
  SiRNA target sequence
caataaatcctgcattaatagcata

SEQ ID NO: 249009 - DNA, 25 bp, Artificial sequence
  SiRNA target sequence
aataaatcctgcattaatagcatag

SEQ ID NO: 249010 - DNA, 25 bp, Artificial sequence
  SiRNA target sequence
ataaatcctgcattaatagcataga

SEQ ID NO: 249011 - DNA, 25 bp, Artificial sequence
  SiRNA target sequence
taaatcctgcattaatagcatagat

SEQ ID NO: 249012 - DNA, 25 bp, Artificial sequence
  SiRNA target sequence
aaatcctgcattaatagcatagatt

SEQ ID NO: 249013 - DNA, 25 bp, Artificial sequence
  SiRNA target sequence
aatcctgcattaatagcatagatta

SEQ ID NO: 249014 - DNA, 25 bp, Artificial sequence
  SiRNA target sequence
atcctgcattaatagcatagattaa

SEQ ID NO: 249015 - DNA, 25 bp, Artificial sequence
  SiRNA target sequence
tcctgcattaatagcatagattaat

SEQ ID NO: 249016 - DNA, 25 bp, Artificial sequence
  SiRNA target sequence
cctgcattaatagcatagattaatg

SEQ ID NO: 249017 - DNA, 25 bp, Artificial sequence
  SiRNA target sequence
ctgcattaatagcatagattaatgc

SEQ ID NO: 249018 - DNA, 25 bp, Artificial sequence
  SiRNA target sequence
tgcattaatagcatagattaatgcc

SEQ ID NO: 249019 - DNA, 25 bp, Artificial sequence
  SiRNA target sequence
gcattaatagcatagattaatgccg

SEQ ID NO: 249020 - DNA, 25 bp, Artificial sequence
  SiRNA target sequence
cattaatagcatagattaatgccgc

SEQ ID NO: 249021 - DNA, 25 bp, Artificial sequence
  SiRNA target sequence
attaatagcatagattaatgccgct

SEQ ID NO: 249022 - DNA, 25 bp, Artificial sequence
  SiRNA target sequence
ttaatagcatagattaatgccgctg

SEQ ID NO: 249023 - DNA, 25 bp, Artificial sequence
  SiRNA target sequence
taatagcatagattaatgccgctgc

SEQ ID NO: 249024 - DNA, 25 bp, Artificial sequence
  SiRNA target sequence
aatagcatagattaatgccgctgca

SEQ ID NO: 249025 - DNA, 25 bp, Artificial sequence
  SiRNA target sequence
atagcatagattaatgccgctgcac

SEQ ID NO: 249026 - DNA, 25 bp, Artificial sequence
  SiRNA target sequence
tagcatagattaatgccgctgcaca

SEQ ID NO: 249027 - DNA, 25 bp, Artificial sequence
  SiRNA target sequence
agcatagattaatgccgctgcacac

SEQ ID NO: 249028 - DNA, 25 bp, Artificial sequence
  SiRNA target sequence
gcatagattaatgccgctgcacaca

SEQ ID NO: 249029 - DNA, 25 bp, Artificial sequence
  SiRNA target sequence
catagattaatgccgctgcacacat

SEQ ID NO: 249030 - DNA, 25 bp, Artificial sequence
  SiRNA target sequence
atagattaatgccgctgcacacata

SEQ ID NO: 249031 - DNA, 25 bp, Artificial sequence
  SiRNA target sequence
tagattaatgccgctgcacacatat

SEQ ID NO: 249032 - DNA, 25 bp, Artificial sequence
  SiRNA target sequence
agattaatgccgctgcacacatatt

SEQ ID NO: 249033 - DNA, 25 bp, Artificial sequence
  SiRNA target sequence
gattaatgccgctgcacacatattt

SEQ ID NO: 249034 - DNA, 25 bp, Artificial sequence
  SiRNA target sequence
attaatgccgctgcacacatatttc

SEQ ID NO: 249035 - DNA, 25 bp, Artificial sequence
  SiRNA target sequence
ttaatgccgctgcacacatatttct

SEQ ID NO: 249036 - DNA, 25 bp, Artificial sequence
  SiRNA target sequence
taatgccgctgcacacatatttctt

SEQ ID NO: 249037 - DNA, 25 bp, Artificial sequence
  SiRNA target sequence
aatgccgctgcacacatatttctta

SEQ ID NO: 249038 - DNA, 25 bp, Artificial sequence
  SiRNA target sequence
atgccgctgcacacatatttcttaa

SEQ ID NO: 249039 - DNA, 25 bp, Artificial sequence
  SiRNA target sequence
tgccgctgcacacatatttcttaaa

SEQ ID NO: 249040 - DNA, 25 bp, Artificial sequence
  SiRNA target sequence
gccgctgcacacatatttcttaaaa

SEQ ID NO: 249041 - DNA, 25 bp, Artificial sequence
  SiRNA target sequence
ccgctgcacacatatttcttaaaaa

SEQ ID NO: 249042 - DNA, 25 bp, Artificial sequence
  SiRNA target sequence
cgctgcacacatatttcttaaaaat

SEQ ID NO: 249043 - DNA, 25 bp, Artificial sequence
  SiRNA target sequence
gctgcacacatatttcttaaaaatt

SEQ ID NO: 249044 - DNA, 25 bp, Artificial sequence
  SiRNA target sequence
ctgcacacatatttcttaaaaattt

SEQ ID NO: 249045 - DNA, 25 bp, Artificial sequence
  SiRNA target sequence
tgcacacatatttcttaaaaatttg

SEQ ID NO: 249046 - DNA, 25 bp, Artificial sequence
  SiRNA target sequence
gcacacatatttcttaaaaatttgg

SEQ ID NO: 249047 - DNA, 25 bp, Artificial sequence
  SiRNA target sequence
cacacatatttcttaaaaatttgga

SEQ ID NO: 249048 - DNA, 25 bp, Artificial sequence
  SiRNA target sequence
acacatatttcttaaaaatttggat

SEQ ID NO: 249049 - DNA, 25 bp, Artificial sequence
  SiRNA target sequence
cacatatttcttaaaaatttggatt

SEQ ID NO: 249050 - DNA, 25 bp, Artificial sequence
  SiRNA target sequence
acatatttcttaaaaatttggattg

SEQ ID NO: 249051 - DNA, 25 bp, Artificial sequence
  SiRNA target sequence
catatttcttaaaaatttggattgt

SEQ ID NO: 249052 - DNA, 25 bp, Artificial sequence
  SiRNA target sequence
atatttcttaaaaatttggattgta

SEQ ID NO: 249053 - DNA, 25 bp, Artificial sequence
  SiRNA target sequence
tatttcttaaaaatttggattgtaa

SEQ ID NO: 249054 - DNA, 25 bp, Artificial sequence
  SiRNA target sequence
atttcttaaaaatttggattgtaaa

SEQ ID NO: 249055 - DNA, 25 bp, Artificial sequence
  SiRNA target sequence
tttcttaaaaatttggattgtaaaa

SEQ ID NO: 249056 - DNA, 25 bp, Artificial sequence
  SiRNA target sequence
ttcttaaaaatttggattgtaaaag

SEQ ID NO: 249057 - DNA, 25 bp, Artificial sequence
  SiRNA target sequence
tcttaaaaatttggattgtaaaaga

SEQ ID NO: 249058 - DNA, 25 bp, Artificial sequence
  SiRNA target sequence
cttaaaaatttggattgtaaaagat

SEQ ID NO: 249059 - DNA, 25 bp, Artificial sequence
  SiRNA target sequence
ttaaaaatttggattgtaaaagatc

SEQ ID NO: 249060 - DNA, 25 bp, Artificial sequence
  SiRNA target sequence
taaaaatttggattgtaaaagatca

SEQ ID NO: 249061 - DNA, 25 bp, Artificial sequence
  SiRNA target sequence
aaaaatttggattgtaaaagatcaa

SEQ ID NO: 249062 - DNA, 25 bp, Artificial sequence
  SiRNA target sequence
aaaatttggattgtaaaagatcaaa

SEQ ID NO: 249063 - DNA, 25 bp, Artificial sequence
  SiRNA target sequence
aaatttggattgtaaaagatcaaac

SEQ ID NO: 249064 - DNA, 25 bp, Artificial sequence
  SiRNA target sequence
aatttggattgtaaaagatcaaacg

SEQ ID NO: 249065 - DNA, 25 bp, Artificial sequence
  SiRNA target sequence
atttggattgtaaaagatcaaacga

SEQ ID NO: 249066 - DNA, 25 bp, Artificial sequence
  SiRNA target sequence
tttggattgtaaaagatcaaacgag

SEQ ID NO: 249067 - DNA, 25 bp, Artificial sequence
  SiRNA target sequence
ttggattgtaaaagatcaaacgagg

SEQ ID NO: 249068 - DNA, 25 bp, Artificial sequence
  SiRNA target sequence
tggattgtaaaagatcaaacgagga

SEQ ID NO: 249069 - DNA, 25 bp, Artificial sequence
  SiRNA target sequence
ggattgtaaaagatcaaacgaggat

SEQ ID NO: 249070 - DNA, 25 bp, Artificial sequence
  SiRNA target sequence
gattgtaaaagatcaaacgaggatg

SEQ ID NO: 249071 - DNA, 25 bp, Artificial sequence
  SiRNA target sequence
attgtaaaagatcaaacgaggatgt

SEQ ID NO: 249072 - DNA, 25 bp, Artificial sequence
  SiRNA target sequence
ttgtaaaagatcaaacgaggatgtc

SEQ ID NO: 249073 - DNA, 25 bp, Artificial sequence
  SiRNA target sequence
tgtaaaagatcaaacgaggatgtcg

SEQ ID NO: 249074 - DNA, 25 bp, Artificial sequence
  SiRNA target sequence
gtaaaagatcaaacgaggatgtcgt

SEQ ID NO: 249075 - DNA, 25 bp, Artificial sequence
  SiRNA target sequence
taaaagatcaaacgaggatgtcgtt

SEQ ID NO: 249076 - DNA, 25 bp, Artificial sequence
  SiRNA target sequence
aaaagatcaaacgaggatgtcgttt

SEQ ID NO: 249077 - DNA, 25 bp, Artificial sequence
  SiRNA target sequence
aaagatcaaacgaggatgtcgtttt

SEQ ID NO: 249078 - DNA, 25 bp, Artificial sequence
  SiRNA target sequence
aagatcaaacgaggatgtcgttttg

SEQ ID NO: 249079 - DNA, 25 bp, Artificial sequence
  SiRNA target sequence
agatcaaacgaggatgtcgttttgt

SEQ ID NO: 249080 - DNA, 25 bp, Artificial sequence
  SiRNA target sequence
gatcaaacgaggatgtcgttttgtc

SEQ ID NO: 249081 - DNA, 25 bp, Artificial sequence
  SiRNA target sequence
atcaaacgaggatgtcgttttgtct

SEQ ID NO: 249082 - DNA, 25 bp, Artificial sequence
  SiRNA target sequence
tcaaacgaggatgtcgttttgtctt

SEQ ID NO: 249083 - DNA, 25 bp, Artificial sequence
  SiRNA target sequence
caaacgaggatgtcgttttgtcttc

SEQ ID NO: 249084 - DNA, 25 bp, Artificial sequence
  SiRNA target sequence
aaacgaggatgtcgttttgtcttct

SEQ ID NO: 249085 - DNA, 25 bp, Artificial sequence
  SiRNA target sequence
aacgaggatgtcgttttgtcttctt

SEQ ID NO: 249086 - DNA, 25 bp, Artificial sequence
  SiRNA target sequence
acgaggatgtcgttttgtcttcttc

SEQ ID NO: 249087 - DNA, 25 bp, Artificial sequence
  SiRNA target sequence
cgaggatgtcgttttgtcttcttct

SEQ ID NO: 249088 - DNA, 25 bp, Artificial sequence
  SiRNA target sequence
gaggatgtcgttttgtcttcttctt

SEQ ID NO: 249089 - DNA, 25 bp, Artificial sequence
  SiRNA target sequence
aggatgtcgttttgtcttcttcttt

SEQ ID NO: 249090 - DNA, 25 bp, Artificial sequence
  SiRNA target sequence
ggatgtcgttttgtcttcttcttta

SEQ ID NO: 249091 - DNA, 25 bp, Artificial sequence
  SiRNA target sequence
gatgtcgttttgtcttcttctttat

SEQ ID NO: 249092 - DNA, 25 bp, Artificial sequence
  SiRNA target sequence
atgtcgttttgtcttcttctttatt

SEQ ID NO: 249093 - DNA, 25 bp, Artificial sequence
  SiRNA target sequence
tgtcgttttgtcttcttctttattt

SEQ ID NO: 249094 - DNA, 25 bp, Artificial sequence
  SiRNA target sequence
gtcgttttgtcttcttctttattta

SEQ ID NO: 249095 - DNA, 25 bp, Artificial sequence
  SiRNA target sequence
tcgttttgtcttcttctttatttat

SEQ ID NO: 249096 - DNA, 25 bp, Artificial sequence
  SiRNA target sequence
cgttttgtcttcttctttatttata

SEQ ID NO: 249097 - DNA, 25 bp, Artificial sequence
  SiRNA target sequence
gttttgtcttcttctttatttatag

SEQ ID NO: 249098 - DNA, 25 bp, Artificial sequence
  SiRNA target sequence
ttttgtcttcttctttatttatagt

SEQ ID NO: 249099 - DNA, 25 bp, Artificial sequence
  SiRNA target sequence
tttgtcttcttctttatttatagtt

SEQ ID NO: 249100 - DNA, 25 bp, Artificial sequence
  SiRNA target sequence
ttgtcttcttctttatttatagttt

SEQ ID NO: 249101 - DNA, 25 bp, Artificial sequence
  SiRNA target sequence
tgtcttcttctttatttatagtttc

SEQ ID NO: 249102 - DNA, 25 bp, Artificial sequence
  SiRNA target sequence
gtcttcttctttatttatagtttcc

SEQ ID NO: 249103 - DNA, 25 bp, Artificial sequence
  SiRNA target sequence
tcttcttctttatttatagtttcct

SEQ ID NO: 249104 - DNA, 25 bp, Artificial sequence
  SiRNA target sequence
cttcttctttatttatagtttcctt

SEQ ID NO: 249105 - DNA, 25 bp, Artificial sequence
  SiRNA target sequence
ttcttctttatttatagtttccttt

SEQ ID NO: 249106 - DNA, 25 bp, Artificial sequence
  SiRNA target sequence
tcttctttatttatagtttccttta

SEQ ID NO: 249107 - DNA, 25 bp, Artificial sequence
  SiRNA target sequence
cttctttatttatagtttcctttat

SEQ ID NO: 249108 - DNA, 25 bp, Artificial sequence
  SiRNA target sequence
ttctttatttatagtttcctttatt

SEQ ID NO: 249109 - DNA, 25 bp, Artificial sequence
  SiRNA target sequence
tctttatttatagtttcctttattt

SEQ ID NO: 249110 - DNA, 25 bp, Artificial sequence
  SiRNA target sequence
ctttatttatagtttcctttatttc

SEQ ID NO: 249111 - DNA, 25 bp, Artificial sequence
  SiRNA target sequence
tttatttatagtttcctttatttct

SEQ ID NO: 249112 - DNA, 25 bp, Artificial sequence
  SiRNA target sequence
ttatttatagtttcctttatttctt

SEQ ID NO: 249113 - DNA, 25 bp, Artificial sequence
  SiRNA target sequence
tatttatagtttcctttatttcttt

SEQ ID NO: 249114 - DNA, 25 bp, Artificial sequence
  SiRNA target sequence
atttatagtttcctttatttcttta

SEQ ID NO: 249115 - DNA, 25 bp, Artificial sequence
  SiRNA target sequence
tttatagtttcctttatttctttag

SEQ ID NO: 249116 - DNA, 25 bp, Artificial sequence
  SiRNA target sequence
ttatagtttcctttatttctttagt

SEQ ID NO: 249117 - DNA, 25 bp, Artificial sequence
  SiRNA target sequence
tatagtttcctttatttctttagtt

SEQ ID NO: 249118 - DNA, 25 bp, Artificial sequence
  SiRNA target sequence
atagtttcctttatttctttagttt

SEQ ID NO: 249119 - DNA, 25 bp, Artificial sequence
  SiRNA target sequence
tagtttcctttatttctttagtttt

SEQ ID NO: 249120 - DNA, 25 bp, Artificial sequence
  SiRNA target sequence
agtttcctttatttctttagtttta

SEQ ID NO: 249121 - DNA, 25 bp, Artificial sequence
  SiRNA target sequence
gtttcctttatttctttagttttaa

SEQ ID NO: 249122 - DNA, 25 bp, Artificial sequence
  SiRNA target sequence
tttcctttatttctttagttttaag

SEQ ID NO: 249123 - DNA, 25 bp, Artificial sequence
  SiRNA target sequence
ttcctttatttctttagttttaaga

SEQ ID NO: 249124 - DNA, 25 bp, Artificial sequence
  SiRNA target sequence
tcctttatttctttagttttaagag

SEQ ID NO: 249125 - DNA, 25 bp, Artificial sequence
  SiRNA target sequence
cctttatttctttagttttaagagg

SEQ ID NO: 249126 - DNA, 25 bp, Artificial sequence
  SiRNA target sequence
ctttatttctttagttttaagagga

SEQ ID NO: 249127 - DNA, 25 bp, Artificial sequence
  SiRNA target sequence
tttatttctttagttttaagaggaa

SEQ ID NO: 249128 - DNA, 25 bp, Artificial sequence
  SiRNA target sequence
ttatttctttagttttaagaggaat

SEQ ID NO: 249129 - DNA, 25 bp, Artificial sequence
  SiRNA target sequence
tatttctttagttttaagaggaata

SEQ ID NO: 249130 - DNA, 25 bp, Artificial sequence
  SiRNA target sequence
atttctttagttttaagaggaatat

SEQ ID NO: 249131 - DNA, 25 bp, Artificial sequence
  SiRNA target sequence
tttctttagttttaagaggaatata

SEQ ID NO: 249132 - DNA, 25 bp, Artificial sequence
  SiRNA target sequence
ttctttagttttaagaggaatataa

SEQ ID NO: 249133 - DNA, 25 bp, Artificial sequence
  SiRNA target sequence
tctttagttttaagaggaatataac

SEQ ID NO: 249134 - DNA, 25 bp, Artificial sequence
  SiRNA target sequence
ctttagttttaagaggaatataact

SEQ ID NO: 249135 - DNA, 25 bp, Artificial sequence
  SiRNA target sequence
tttagttttaagaggaatataactt

SEQ ID NO: 249136 - DNA, 25 bp, Artificial sequence
  SiRNA target sequence
ttagttttaagaggaatataacttt

SEQ ID NO: 249137 - DNA, 25 bp, Artificial sequence
  SiRNA target sequence
tagttttaagaggaatataactttt

SEQ ID NO: 249138 - DNA, 25 bp, Artificial sequence
  SiRNA target sequence
agttttaagaggaatataacttttt

SEQ ID NO: 249139 - DNA, 25 bp, Artificial sequence
  SiRNA target sequence
gttttaagaggaatataacttttta

SEQ ID NO: 249140 - DNA, 25 bp, Artificial sequence
  SiRNA target sequence
ttttaagaggaatataactttttaa

SEQ ID NO: 249141 - DNA, 25 bp, Artificial sequence
  SiRNA target sequence
tttaagaggaatataactttttaaa

SEQ ID NO: 249142 - DNA, 25 bp, Artificial sequence
  SiRNA target sequence
ttaagaggaatataactttttaaaa

SEQ ID NO: 249143 - DNA, 25 bp, Artificial sequence
  SiRNA target sequence
taagaggaatataactttttaaaaa

SEQ ID NO: 249144 - DNA, 25 bp, Artificial sequence
  SiRNA target sequence
aagaggaatataactttttaaaaag

SEQ ID NO: 249145 - DNA, 25 bp, Artificial sequence
  SiRNA target sequence
agaggaatataactttttaaaaagt

SEQ ID NO: 249146 - DNA, 25 bp, Artificial sequence
  SiRNA target sequence
gaggaatataactttttaaaaagta

SEQ ID NO: 249147 - DNA, 25 bp, Artificial sequence
  SiRNA target sequence
aggaatataactttttaaaaagtaa

SEQ ID NO: 249148 - DNA, 25 bp, Artificial sequence
  SiRNA target sequence
ggaatataactttttaaaaagtaaa

SEQ ID NO: 249149 - DNA, 25 bp, Artificial sequence
  SiRNA target sequence
gaatataactttttaaaaagtaaat

SEQ ID NO: 249150 - DNA, 25 bp, Artificial sequence
  SiRNA target sequence
aatataactttttaaaaagtaaatt

SEQ ID NO: 249151 - DNA, 25 bp, Artificial sequence
  SiRNA target sequence
atataactttttaaaaagtaaatta

SEQ ID NO: 249152 - DNA, 25 bp, Artificial sequence
  SiRNA target sequence
tataactttttaaaaagtaaattaa

SEQ ID NO: 249153 - DNA, 25 bp, Artificial sequence
  SiRNA target sequence
ataactttttaaaaagtaaattaat

SEQ ID NO: 249154 - DNA, 25 bp, Artificial sequence
  SiRNA target sequence
taactttttaaaaagtaaattaatg

SEQ ID NO: 249155 - DNA, 25 bp, Artificial sequence
  SiRNA target sequence
aactttttaaaaagtaaattaatgt

SEQ ID NO: 249156 - DNA, 25 bp, Artificial sequence
  SiRNA target sequence
actttttaaaaagtaaattaatgta

SEQ ID NO: 249157 - DNA, 25 bp, Artificial sequence
  SiRNA target sequence
ctttttaaaaagtaaattaatgtag

SEQ ID NO: 249158 - DNA, 25 bp, Artificial sequence
  SiRNA target sequence
tttttaaaaagtaaattaatgtagt

SEQ ID NO: 249159 - DNA, 25 bp, Artificial sequence
  SiRNA target sequence
ttttaaaaagtaaattaatgtagtt

SEQ ID NO: 249160 - DNA, 25 bp, Artificial sequence
  SiRNA target sequence
tttaaaaagtaaattaatgtagtta

SEQ ID NO: 249161 - DNA, 25 bp, Artificial sequence
  SiRNA target sequence
ttaaaaagtaaattaatgtagttac

SEQ ID NO: 249162 - DNA, 25 bp, Artificial sequence
  SiRNA target sequence
taaaaagtaaattaatgtagttaca

SEQ ID NO: 249163 - DNA, 25 bp, Artificial sequence
  SiRNA target sequence
aaaaagtaaattaatgtagttacaa

SEQ ID NO: 249164 - DNA, 25 bp, Artificial sequence
  SiRNA target sequence
aaaagtaaattaatgtagttacaaa

SEQ ID NO: 249165 - DNA, 25 bp, Artificial sequence
  SiRNA target sequence
aaagtaaattaatgtagttacaaaa

SEQ ID NO: 249166 - DNA, 25 bp, Artificial sequence
  SiRNA target sequence
aagtaaattaatgtagttacaaaag

SEQ ID NO: 249167 - DNA, 25 bp, Artificial sequence
  SiRNA target sequence
agtaaattaatgtagttacaaaaga

SEQ ID NO: 249168 - DNA, 25 bp, Artificial sequence
  SiRNA target sequence
gtaaattaatgtagttacaaaagac

SEQ ID NO: 249169 - DNA, 25 bp, Artificial sequence
  SiRNA target sequence
taaattaatgtagttacaaaagaca

SEQ ID NO: 249170 - DNA, 25 bp, Artificial sequence
  SiRNA target sequence
aaattaatgtagttacaaaagacaa

SEQ ID NO: 249171 - DNA, 25 bp, Artificial sequence
  SiRNA target sequence
aattaatgtagttacaaaagacaag

SEQ ID NO: 249172 - DNA, 25 bp, Artificial sequence
  SiRNA target sequence
attaatgtagttacaaaagacaaga

SEQ ID NO: 249173 - DNA, 25 bp, Artificial sequence
  SiRNA target sequence
ttaatgtagttacaaaagacaagat

SEQ ID NO: 249174 - DNA, 25 bp, Artificial sequence
  SiRNA target sequence
taatgtagttacaaaagacaagatc

SEQ ID NO: 249175 - DNA, 25 bp, Artificial sequence
  SiRNA target sequence
aatgtagttacaaaagacaagatca

SEQ ID NO: 249176 - DNA, 25 bp, Artificial sequence
  SiRNA target sequence
atgtagttacaaaagacaagatcaa

SEQ ID NO: 249177 - DNA, 25 bp, Artificial sequence
  SiRNA target sequence
tgtagttacaaaagacaagatcaaa

SEQ ID NO: 249178 - DNA, 25 bp, Artificial sequence
  SiRNA target sequence
gtagttacaaaagacaagatcaaaa

SEQ ID NO: 249179 - DNA, 25 bp, Artificial sequence
  SiRNA target sequence
tagttacaaaagacaagatcaaaaa

SEQ ID NO: 249180 - DNA, 25 bp, Artificial sequence
  SiRNA target sequence
agttacaaaagacaagatcaaaaaa

SEQ ID NO: 249181 - DNA, 25 bp, Artificial sequence
  SiRNA target sequence
gttacaaaagacaagatcaaaaaaa

SEQ ID NO: 249182 - DNA, 25 bp, Artificial sequence
  SiRNA target sequence
ttacaaaagacaagatcaaaaaaaa

SEQ ID NO: 249183 - DNA, 25 bp, Artificial sequence
  SiRNA target sequence
tacaaaagacaagatcaaaaaaaac

SEQ ID NO: 249184 - DNA, 25 bp, Artificial sequence
  SiRNA target sequence
acaaaagacaagatcaaaaaaaaca

SEQ ID NO: 249185 - DNA, 25 bp, Artificial sequence
  SiRNA target sequence
caaaagacaagatcaaaaaaaacaa

SEQ ID NO: 249186 - DNA, 25 bp, Artificial sequence
  SiRNA target sequence
aaaagacaagatcaaaaaaaacaaa

SEQ ID NO: 249187 - DNA, 25 bp, Artificial sequence
  SiRNA target sequence
aaagacaagatcaaaaaaaacaaac

SEQ ID NO: 249188 - DNA, 25 bp, Artificial sequence
  SiRNA target sequence
aagacaagatcaaaaaaaacaaact

SEQ ID NO: 249189 - DNA, 25 bp, Artificial sequence
  SiRNA target sequence
agacaagatcaaaaaaaacaaacta

SEQ ID NO: 249190 - DNA, 25 bp, Artificial sequence
  SiRNA target sequence
gacaagatcaaaaaaaacaaactac

SEQ ID NO: 249191 - DNA, 25 bp, Artificial sequence
  SiRNA target sequence
acaagatcaaaaaaaacaaactact

SEQ ID NO: 249192 - DNA, 25 bp, Artificial sequence
  SiRNA target sequence
caagatcaaaaaaaacaaactacta

SEQ ID NO: 249193 - DNA, 25 bp, Artificial sequence
  SiRNA target sequence
aagatcaaaaaaaacaaactactac

SEQ ID NO: 249194 - DNA, 25 bp, Artificial sequence
  SiRNA target sequence
agatcaaaaaaaacaaactactacc

SEQ ID NO: 249195 - DNA, 25 bp, Artificial sequence
  SiRNA target sequence
gatcaaaaaaaacaaactactaccg

SEQ ID NO: 249196 - DNA, 25 bp, Artificial sequence
  SiRNA target sequence
atcaaaaaaaacaaactactaccgt

SEQ ID NO: 249197 - DNA, 25 bp, Artificial sequence
  SiRNA target sequence
tcaaaaaaaacaaactactaccgtc

SEQ ID NO: 249198 - DNA, 25 bp, Artificial sequence
  SiRNA target sequence
caaaaaaaacaaactactaccgtca

SEQ ID NO: 249199 - DNA, 25 bp, Artificial sequence
  SiRNA target sequence
aaaaaaaacaaactactaccgtcaa

SEQ ID NO: 249200 - DNA, 25 bp, Artificial sequence
  SiRNA target sequence
aaaaaaacaaactactaccgtcaat

SEQ ID NO: 249201 - DNA, 25 bp, Artificial sequence
  SiRNA target sequence
aaaaaacaaactactaccgtcaatt

SEQ ID NO: 249202 - DNA, 25 bp, Artificial sequence
  SiRNA target sequence
aaaaacaaactactaccgtcaattt

SEQ ID NO: 249203 - DNA, 25 bp, Artificial sequence
  SiRNA target sequence
aaaacaaactactaccgtcaatttt

SEQ ID NO: 249204 - DNA, 25 bp, Artificial sequence
  SiRNA target sequence
aaacaaactactaccgtcaatttta

SEQ ID NO: 249205 - DNA, 25 bp, Artificial sequence
  SiRNA target sequence
aacaaactactaccgtcaattttat

SEQ ID NO: 249206 - DNA, 25 bp, Artificial sequence
  SiRNA target sequence
acaaactactaccgtcaattttatc

SEQ ID NO: 249207 - DNA, 25 bp, Artificial sequence
  SiRNA target sequence
caaactactaccgtcaattttatca

SEQ ID NO: 249208 - DNA, 25 bp, Artificial sequence
  SiRNA target sequence
aaactactaccgtcaattttatcat

SEQ ID NO: 249209 - DNA, 25 bp, Artificial sequence
  SiRNA target sequence
aactactaccgtcaattttatcatg

SEQ ID NO: 249210 - DNA, 25 bp, Artificial sequence
  SiRNA target sequence
actactaccgtcaattttatcatgc

SEQ ID NO: 249211 - DNA, 25 bp, Artificial sequence
  SiRNA target sequence
ctactaccgtcaattttatcatgca

SEQ ID NO: 249212 - DNA, 25 bp, Artificial sequence
  SiRNA target sequence
tactaccgtcaattttatcatgcaa

SEQ ID NO: 249213 - DNA, 25 bp, Artificial sequence
  SiRNA target sequence
actaccgtcaattttatcatgcaaa

SEQ ID NO: 249214 - DNA, 25 bp, Artificial sequence
  SiRNA target sequence
ctaccgtcaattttatcatgcaaac

SEQ ID NO: 249215 - DNA, 25 bp, Artificial sequence
  SiRNA target sequence
taccgtcaattttatcatgcaaacc

SEQ ID NO: 249216 - DNA, 25 bp, Artificial sequence
  SiRNA target sequence
accgtcaattttatcatgcaaacct

SEQ ID NO: 249217 - DNA, 25 bp, Artificial sequence
  SiRNA target sequence
ccgtcaattttatcatgcaaacctg

SEQ ID NO: 249218 - DNA, 25 bp, Artificial sequence
  SiRNA target sequence
cgtcaattttatcatgcaaacctgc

SEQ ID NO: 249219 - DNA, 25 bp, Artificial sequence
  SiRNA target sequence
gtcaattttatcatgcaaacctgca

SEQ ID NO: 249220 - DNA, 25 bp, Artificial sequence
  SiRNA target sequence
tcaattttatcatgcaaacctgcag

SEQ ID NO: 249221 - DNA, 25 bp, Artificial sequence
  SiRNA target sequence
caattttatcatgcaaacctgcagg

SEQ ID NO: 249222 - DNA, 25 bp, Artificial sequence
  SiRNA target sequence
aattttatcatgcaaacctgcagga

SEQ ID NO: 249223 - DNA, 25 bp, Artificial sequence
  SiRNA target sequence
attttatcatgcaaacctgcaggaa

SEQ ID NO: 249224 - DNA, 25 bp, Artificial sequence
  SiRNA target sequence
ttttatcatgcaaacctgcaggaag

SEQ ID NO: 249225 - DNA, 25 bp, Artificial sequence
  SiRNA target sequence
tttatcatgcaaacctgcaggaagt

SEQ ID NO: 249226 - DNA, 25 bp, Artificial sequence
  SiRNA target sequence
ttatcatgcaaacctgcaggaagta

SEQ ID NO: 249227 - DNA, 25 bp, Artificial sequence
  SiRNA target sequence
tatcatgcaaacctgcaggaagtat

SEQ ID NO: 249228 - DNA, 25 bp, Artificial sequence
  SiRNA target sequence
atcatgcaaacctgcaggaagtata

SEQ ID NO: 249229 - DNA, 25 bp, Artificial sequence
  SiRNA target sequence
tcatgcaaacctgcaggaagtatat

SEQ ID NO: 249230 - DNA, 25 bp, Artificial sequence
  SiRNA target sequence
catgcaaacctgcaggaagtatatt

SEQ ID NO: 249231 - DNA, 25 bp, Artificial sequence
  SiRNA target sequence
atgcaaacctgcaggaagtatattt

SEQ ID NO: 249232 - DNA, 25 bp, Artificial sequence
  SiRNA target sequence
tgcaaacctgcaggaagtatatttg

SEQ ID NO: 249233 - DNA, 25 bp, Artificial sequence
  SiRNA target sequence
gcaaacctgcaggaagtatatttgc

SEQ ID NO: 249234 - DNA, 25 bp, Artificial sequence
  SiRNA target sequence
caaacctgcaggaagtatatttgct

SEQ ID NO: 249235 - DNA, 25 bp, Artificial sequence
  SiRNA target sequence
aaacctgcaggaagtatatttgcta

SEQ ID NO: 249236 - DNA, 25 bp, Artificial sequence
  SiRNA target sequence
aacctgcaggaagtatatttgctaa

SEQ ID NO: 249237 - DNA, 25 bp, Artificial sequence
  SiRNA target sequence
acctgcaggaagtatatttgctaat

SEQ ID NO: 249238 - DNA, 25 bp, Artificial sequence
  SiRNA target sequence
cctgcaggaagtatatttgctaatt

SEQ ID NO: 249239 - DNA, 25 bp, Artificial sequence
  SiRNA target sequence
ctgcaggaagtatatttgctaattc

SEQ ID NO: 249240 - DNA, 25 bp, Artificial sequence
  SiRNA target sequence
tgcaggaagtatatttgctaattca

SEQ ID NO: 249241 - DNA, 25 bp, Artificial sequence
  SiRNA target sequence
gcaggaagtatatttgctaattcat

SEQ ID NO: 249242 - DNA, 25 bp, Artificial sequence
  SiRNA target sequence
caggaagtatatttgctaattcatc

SEQ ID NO: 249243 - DNA, 25 bp, Artificial sequence
  SiRNA target sequence
aggaagtatatttgctaattcatct

SEQ ID NO: 249244 - DNA, 25 bp, Artificial sequence
  SiRNA target sequence
ggaagtatatttgctaattcatctt

SEQ ID NO: 249245 - DNA, 25 bp, Artificial sequence
  SiRNA target sequence
gaagtatatttgctaattcatcttt

SEQ ID NO: 249246 - DNA, 25 bp, Artificial sequence
  SiRNA target sequence
aagtatatttgctaattcatctttt

SEQ ID NO: 249247 - DNA, 25 bp, Artificial sequence
  SiRNA target sequence
agtatatttgctaattcatctttta

SEQ ID NO: 249248 - DNA, 25 bp, Artificial sequence
  SiRNA target sequence
gtatatttgctaattcatcttttat

SEQ ID NO: 249249 - DNA, 25 bp, Artificial sequence
  SiRNA target sequence
tatatttgctaattcatcttttata

SEQ ID NO: 249250 - DNA, 25 bp, Artificial sequence
  SiRNA target sequence
atatttgctaattcatcttttatat

SEQ ID NO: 249251 - DNA, 25 bp, Artificial sequence
  SiRNA target sequence
tatttgctaattcatcttttatata

SEQ ID NO: 249252 - DNA, 25 bp, Artificial sequence
  SiRNA target sequence
atttgctaattcatcttttatataa

SEQ ID NO: 249253 - DNA, 25 bp, Artificial sequence
  SiRNA target sequence
tttgctaattcatcttttatataaa

SEQ ID NO: 249254 - DNA, 25 bp, Artificial sequence
  SiRNA target sequence
ttgctaattcatcttttatataaat

SEQ ID NO: 249255 - DNA, 25 bp, Artificial sequence
  SiRNA target sequence
tgctaattcatcttttatataaata

SEQ ID NO: 249256 - DNA, 25 bp, Artificial sequence
  SiRNA target sequence
gctaattcatcttttatataaataa

SEQ ID NO: 249257 - DNA, 25 bp, Artificial sequence
  SiRNA target sequence
ctaattcatcttttatataaataaa

SEQ ID NO: 249258 - DNA, 25 bp, Artificial sequence
  SiRNA target sequence
taattcatcttttatataaataaaa

SEQ ID NO: 249259 - DNA, 25 bp, Artificial sequence
  SiRNA target sequence
aattcatcttttatataaataaaag

SEQ ID NO: 249260 - DNA, 25 bp, Artificial sequence
  SiRNA target sequence
attcatcttttatataaataaaagc

SEQ ID NO: 249261 - DNA, 25 bp, Artificial sequence
  SiRNA target sequence
ttcatcttttatataaataaaagct

SEQ ID NO: 249262 - DNA, 25 bp, Artificial sequence
  SiRNA target sequence
tcatcttttatataaataaaagcta

SEQ ID NO: 249263 - DNA, 25 bp, Artificial sequence
  SiRNA target sequence
catcttttatataaataaaagctac

SEQ ID NO: 249264 - DNA, 25 bp, Artificial sequence
  SiRNA target sequence
atcttttatataaataaaagctaca

SEQ ID NO: 249265 - DNA, 25 bp, Artificial sequence
  SiRNA target sequence
tcttttatataaataaaagctacag

SEQ ID NO: 249266 - DNA, 25 bp, Artificial sequence
  SiRNA target sequence
cttttatataaataaaagctacaga

SEQ ID NO: 249267 - DNA, 25 bp, Artificial sequence
  SiRNA target sequence
ttttatataaataaaagctacagaa

SEQ ID NO: 249268 - DNA, 25 bp, Artificial sequence
  SiRNA target sequence
tttatataaataaaagctacagaaa

SEQ ID NO: 249269 - DNA, 25 bp, Artificial sequence
  SiRNA target sequence
ttatataaataaaagctacagaaat

SEQ ID NO: 249270 - DNA, 25 bp, Artificial sequence
  SiRNA target sequence
tatataaataaaagctacagaaata

SEQ ID NO: 249271 - DNA, 25 bp, Artificial sequence
  SiRNA target sequence
atataaataaaagctacagaaataa

SEQ ID NO: 249272 - DNA, 25 bp, Artificial sequence
  SiRNA target sequence
tataaataaaagctacagaaataat

SEQ ID NO: 249273 - DNA, 25 bp, Artificial sequence
  SiRNA target sequence
ataaataaaagctacagaaataatc

SEQ ID NO: 249274 - DNA, 25 bp, Artificial sequence
  SiRNA target sequence
taaataaaagctacagaaataatca

SEQ ID NO: 249275 - DNA, 25 bp, Artificial sequence
  SiRNA target sequence
aaataaaagctacagaaataatcat

SEQ ID NO: 249276 - DNA, 25 bp, Artificial sequence
  SiRNA target sequence
aataaaagctacagaaataatcatt

SEQ ID NO: 249277 - DNA, 25 bp, Artificial sequence
  SiRNA target sequence
ataaaagctacagaaataatcattg

SEQ ID NO: 249278 - DNA, 25 bp, Artificial sequence
  SiRNA target sequence
taaaagctacagaaataatcattga

SEQ ID NO: 249279 - DNA, 25 bp, Artificial sequence
  SiRNA target sequence
aaaagctacagaaataatcattgaa

SEQ ID NO: 249280 - DNA, 25 bp, Artificial sequence
  SiRNA target sequence
aaagctacagaaataatcattgaaa

SEQ ID NO: 249281 - DNA, 25 bp, Artificial sequence
  SiRNA target sequence
aagctacagaaataatcattgaaat

SEQ ID NO: 249282 - DNA, 25 bp, Artificial sequence
  SiRNA target sequence
agctacagaaataatcattgaaatg

SEQ ID NO: 249283 - DNA, 25 bp, Artificial sequence
  SiRNA target sequence
gctacagaaataatcattgaaatgg

SEQ ID NO: 249284 - DNA, 25 bp, Artificial sequence
  SiRNA target sequence
ctacagaaataatcattgaaatggc

SEQ ID NO: 249285 - DNA, 25 bp, Artificial sequence
  SiRNA target sequence
tacagaaataatcattgaaatggcg

SEQ ID NO: 249286 - DNA, 25 bp, Artificial sequence
  SiRNA target sequence
acagaaataatcattgaaatggcgg

SEQ ID NO: 249287 - DNA, 25 bp, Artificial sequence
  SiRNA target sequence
cagaaataatcattgaaatggcggt

SEQ ID NO: 249288 - DNA, 25 bp, Artificial sequence
  SiRNA target sequence
agaaataatcattgaaatggcggtg

SEQ ID NO: 249289 - DNA, 25 bp, Artificial sequence
  SiRNA target sequence
gaaataatcattgaaatggcggtga

SEQ ID NO: 249290 - DNA, 25 bp, Artificial sequence
  SiRNA target sequence
aaataatcattgaaatggcggtgat

SEQ ID NO: 249291 - DNA, 25 bp, Artificial sequence
  SiRNA target sequence
aataatcattgaaatggcggtgatt

SEQ ID NO: 249292 - DNA, 25 bp, Artificial sequence
  SiRNA target sequence
ataatcattgaaatggcggtgattg

SEQ ID NO: 249293 - DNA, 25 bp, Artificial sequence
  SiRNA target sequence
taatcattgaaatggcggtgattgt

SEQ ID NO: 249294 - DNA, 25 bp, Artificial sequence
  SiRNA target sequence
aatcattgaaatggcggtgattgtg

SEQ ID NO: 249295 - DNA, 25 bp, Artificial sequence
  SiRNA target sequence
atcattgaaatggcggtgattgtgg

SEQ ID NO: 249296 - DNA, 25 bp, Artificial sequence
  SiRNA target sequence
tcattgaaatggcggtgattgtgga

SEQ ID NO: 249297 - DNA, 25 bp, Artificial sequence
  SiRNA target sequence
cattgaaatggcggtgattgtggaa

SEQ ID NO: 249298 - DNA, 25 bp, Artificial sequence
  SiRNA target sequence
attgaaatggcggtgattgtggaaa

SEQ ID NO: 249299 - DNA, 25 bp, Artificial sequence
  SiRNA target sequence
ttgaaatggcggtgattgtggaaaa

SEQ ID NO: 249300 - DNA, 25 bp, Artificial sequence
  SiRNA target sequence
tgaaatggcggtgattgtggaaaaa

SEQ ID NO: 249301 - DNA, 25 bp, Artificial sequence
  SiRNA target sequence
gaaatggcggtgattgtggaaaaat

SEQ ID NO: 249302 - DNA, 25 bp, Artificial sequence
  SiRNA target sequence
aaatggcggtgattgtggaaaaatt

SEQ ID NO: 249303 - DNA, 25 bp, Artificial sequence
  SiRNA target sequence
aatggcggtgattgtggaaaaatta

SEQ ID NO: 249304 - DNA, 25 bp, Artificial sequence
  SiRNA target sequence
atggcggtgattgtggaaaaattag

SEQ ID NO: 249305 - DNA, 25 bp, Artificial sequence
  SiRNA target sequence
tggcggtgattgtggaaaaattagg

SEQ ID NO: 249306 - DNA, 25 bp, Artificial sequence
  SiRNA target sequence
ggcggtgattgtggaaaaattagga

SEQ ID NO: 249307 - DNA, 25 bp, Artificial sequence
  SiRNA target sequence
gcggtgattgtggaaaaattaggaa

SEQ ID NO: 249308 - DNA, 25 bp, Artificial sequence
  SiRNA target sequence
cggtgattgtggaaaaattaggaac

SEQ ID NO: 249309 - DNA, 25 bp, Artificial sequence
  SiRNA target sequence
ggtgattgtggaaaaattaggaaca

SEQ ID NO: 249310 - DNA, 25 bp, Artificial sequence
  SiRNA target sequence
gtgattgtggaaaaattaggaacaa

SEQ ID NO: 249311 - DNA, 25 bp, Artificial sequence
  SiRNA target sequence
tgattgtggaaaaattaggaacaat

SEQ ID NO: 249312 - DNA, 25 bp, Artificial sequence
  SiRNA target sequence
gattgtggaaaaattaggaacaatt

SEQ ID NO: 249313 - DNA, 25 bp, Artificial sequence
  SiRNA target sequence
attgtggaaaaattaggaacaattt

SEQ ID NO: 249314 - DNA, 25 bp, Artificial sequence
  SiRNA target sequence
ttgtggaaaaattaggaacaatttc

SEQ ID NO: 249315 - DNA, 25 bp, Artificial sequence
  SiRNA target sequence
tgtggaaaaattaggaacaatttct

SEQ ID NO: 249316 - DNA, 25 bp, Artificial sequence
  SiRNA target sequence
gtggaaaaattaggaacaatttctt

SEQ ID NO: 249317 - DNA, 25 bp, Artificial sequence
  SiRNA target sequence
tggaaaaattaggaacaatttcttt

SEQ ID NO: 249318 - DNA, 25 bp, Artificial sequence
  SiRNA target sequence
ggaaaaattaggaacaatttctttc

SEQ ID NO: 249319 - DNA, 25 bp, Artificial sequence
  SiRNA target sequence
gaaaaattaggaacaatttctttca

SEQ ID NO: 249320 - DNA, 25 bp, Artificial sequence
  SiRNA target sequence
aaaaattaggaacaatttctttcat

SEQ ID NO: 249321 - DNA, 25 bp, Artificial sequence
  SiRNA target sequence
aaaattaggaacaatttctttcatt

SEQ ID NO: 249322 - DNA, 25 bp, Artificial sequence
  SiRNA target sequence
aaattaggaacaatttctttcattt

SEQ ID NO: 249323 - DNA, 25 bp, Artificial sequence
  SiRNA target sequence
aattaggaacaatttctttcatttc

SEQ ID NO: 249324 - DNA, 25 bp, Artificial sequence
  SiRNA target sequence
attaggaacaatttctttcatttca

SEQ ID NO: 249325 - DNA, 25 bp, Artificial sequence
  SiRNA target sequence
ttaggaacaatttctttcatttcat

SEQ ID NO: 249326 - DNA, 25 bp, Artificial sequence
  SiRNA target sequence
taggaacaatttctttcatttcatc

SEQ ID NO: 249327 - DNA, 25 bp, Artificial sequence
  SiRNA target sequence
aggaacaatttctttcatttcatct

SEQ ID NO: 249328 - DNA, 25 bp, Artificial sequence
  SiRNA target sequence
ggaacaatttctttcatttcatctt

SEQ ID NO: 249329 - DNA, 25 bp, Artificial sequence
  SiRNA target sequence
gaacaatttctttcatttcatcttc

SEQ ID NO: 249330 - DNA, 25 bp, Artificial sequence
  SiRNA target sequence
aacaatttctttcatttcatcttct

SEQ ID NO: 249331 - DNA, 25 bp, Artificial sequence
  SiRNA target sequence
acaatttctttcatttcatcttctg

SEQ ID NO: 249332 - DNA, 25 bp, Artificial sequence
  SiRNA target sequence
caatttctttcatttcatcttctgt

SEQ ID NO: 249333 - DNA, 25 bp, Artificial sequence
  SiRNA target sequence
aatttctttcatttcatcttctgta

SEQ ID NO: 249334 - DNA, 25 bp, Artificial sequence
  SiRNA target sequence
atttctttcatttcatcttctgtac

SEQ ID NO: 249335 - DNA, 25 bp, Artificial sequence
  SiRNA target sequence
tttctttcatttcatcttctgtaca

SEQ ID NO: 249336 - DNA, 25 bp, Artificial sequence
  SiRNA target sequence
ttctttcatttcatcttctgtacaa

SEQ ID NO: 249337 - DNA, 25 bp, Artificial sequence
  SiRNA target sequence
tctttcatttcatcttctgtacaag

SEQ ID NO: 249338 - DNA, 25 bp, Artificial sequence
  SiRNA target sequence
ctttcatttcatcttctgtacaagc

SEQ ID NO: 249339 - DNA, 25 bp, Artificial sequence
  SiRNA target sequence
tttcatttcatcttctgtacaagca

SEQ ID NO: 249340 - DNA, 25 bp, Artificial sequence
  SiRNA target sequence
ttcatttcatcttctgtacaagcat

SEQ ID NO: 249341 - DNA, 25 bp, Artificial sequence
  SiRNA target sequence
tcatttcatcttctgtacaagcatg

SEQ ID NO: 249342 - DNA, 25 bp, Artificial sequence
  SiRNA target sequence
catttcatcttctgtacaagcatga

SEQ ID NO: 249343 - DNA, 25 bp, Artificial sequence
  SiRNA target sequence
atttcatcttctgtacaagcatgat

SEQ ID NO: 249344 - DNA, 25 bp, Artificial sequence
  SiRNA target sequence
tttcatcttctgtacaagcatgatt

SEQ ID NO: 249345 - DNA, 25 bp, Artificial sequence
  SiRNA target sequence
ttcatcttctgtacaagcatgattg

SEQ ID NO: 249346 - DNA, 25 bp, Artificial sequence
  SiRNA target sequence
tcatcttctgtacaagcatgattgg

SEQ ID NO: 249347 - DNA, 25 bp, Artificial sequence
  SiRNA target sequence
catcttctgtacaagcatgattggc

SEQ ID NO: 249348 - DNA, 25 bp, Artificial sequence
  SiRNA target sequence
atcttctgtacaagcatgattggct

SEQ ID NO: 249349 - DNA, 25 bp, Artificial sequence
  SiRNA target sequence
tcttctgtacaagcatgattggcta

SEQ ID NO: 249350 - DNA, 25 bp, Artificial sequence
  SiRNA target sequence
cttctgtacaagcatgattggctaa

SEQ ID NO: 249351 - DNA, 25 bp, Artificial sequence
  SiRNA target sequence
ttctgtacaagcatgattggctaac

SEQ ID NO: 249352 - DNA, 25 bp, Artificial sequence
  SiRNA target sequence
tctgtacaagcatgattggctaacg

SEQ ID NO: 249353 - DNA, 25 bp, Artificial sequence
  SiRNA target sequence
ctgtacaagcatgattggctaacgc

SEQ ID NO: 249354 - DNA, 25 bp, Artificial sequence
  SiRNA target sequence
tgtacaagcatgattggctaacgca

SEQ ID NO: 249355 - DNA, 25 bp, Artificial sequence
  SiRNA target sequence
gtacaagcatgattggctaacgcat

SEQ ID NO: 249356 - DNA, 25 bp, Artificial sequence
  SiRNA target sequence
tacaagcatgattggctaacgcata

SEQ ID NO: 249357 - DNA, 25 bp, Artificial sequence
  SiRNA target sequence
acaagcatgattggctaacgcatat

SEQ ID NO: 249358 - DNA, 25 bp, Artificial sequence
  SiRNA target sequence
caagcatgattggctaacgcatata

SEQ ID NO: 249359 - DNA, 25 bp, Artificial sequence
  SiRNA target sequence
aagcatgattggctaacgcatataa

SEQ ID NO: 249360 - DNA, 25 bp, Artificial sequence
  SiRNA target sequence
agcatgattggctaacgcatataaa

SEQ ID NO: 249361 - DNA, 25 bp, Artificial sequence
  SiRNA target sequence
gcatgattggctaacgcatataaag

SEQ ID NO: 249362 - DNA, 25 bp, Artificial sequence
  SiRNA target sequence
catgattggctaacgcatataaagc

SEQ ID NO: 249363 - DNA, 25 bp, Artificial sequence
  SiRNA target sequence
atgattggctaacgcatataaagca

SEQ ID NO: 249364 - DNA, 25 bp, Artificial sequence
  SiRNA target sequence
tgattggctaacgcatataaagcaa

SEQ ID NO: 249365 - DNA, 25 bp, Artificial sequence
  SiRNA target sequence
gattggctaacgcatataaagcaaa

SEQ ID NO: 249366 - DNA, 25 bp, Artificial sequence
  SiRNA target sequence
attggctaacgcatataaagcaaaa

SEQ ID NO: 249367 - DNA, 25 bp, Artificial sequence
  SiRNA target sequence
ttggctaacgcatataaagcaaaac

SEQ ID NO: 249368 - DNA, 25 bp, Artificial sequence
  SiRNA target sequence
tggctaacgcatataaagcaaaacc

SEQ ID NO: 249369 - DNA, 25 bp, Artificial sequence
  SiRNA target sequence
ggctaacgcatataaagcaaaacca

SEQ ID NO: 249370 - DNA, 25 bp, Artificial sequence
  SiRNA target sequence
gctaacgcatataaagcaaaaccaa

SEQ ID NO: 249371 - DNA, 25 bp, Artificial sequence
  SiRNA target sequence
ctaacgcatataaagcaaaaccaac

SEQ ID NO: 249372 - DNA, 25 bp, Artificial sequence
  SiRNA target sequence
taacgcatataaagcaaaaccaact

SEQ ID NO: 249373 - DNA, 25 bp, Artificial sequence
  SiRNA target sequence
aacgcatataaagcaaaaccaacta

SEQ ID NO: 249374 - DNA, 25 bp, Artificial sequence
  SiRNA target sequence
acgcatataaagcaaaaccaactac

SEQ ID NO: 249375 - DNA, 25 bp, Artificial sequence
  SiRNA target sequence
cgcatataaagcaaaaccaactact

SEQ ID NO: 249376 - DNA, 25 bp, Artificial sequence
  SiRNA target sequence
gcatataaagcaaaaccaactacta

SEQ ID NO: 249377 - DNA, 25 bp, Artificial sequence
  SiRNA target sequence
catataaagcaaaaccaactactag

SEQ ID NO: 249378 - DNA, 25 bp, Artificial sequence
  SiRNA target sequence
atataaagcaaaaccaactactaga

SEQ ID NO: 249379 - DNA, 25 bp, Artificial sequence
  SiRNA target sequence
tataaagcaaaaccaactactagag

SEQ ID NO: 249380 - DNA, 25 bp, Artificial sequence
  SiRNA target sequence
ataaagcaaaaccaactactagagt

SEQ ID NO: 249381 - DNA, 25 bp, Artificial sequence
  SiRNA target sequence
taaagcaaaaccaactactagagta

SEQ ID NO: 249382 - DNA, 25 bp, Artificial sequence
  SiRNA target sequence
aaagcaaaaccaactactagagtac

SEQ ID NO: 249383 - DNA, 25 bp, Artificial sequence
  SiRNA target sequence
aagcaaaaccaactactagagtact

SEQ ID NO: 249384 - DNA, 25 bp, Artificial sequence
  SiRNA target sequence
agcaaaaccaactactagagtactc

SEQ ID NO: 249385 - DNA, 25 bp, Artificial sequence
  SiRNA target sequence
gcaaaaccaactactagagtactcc

SEQ ID NO: 249386 - DNA, 25 bp, Artificial sequence
  SiRNA target sequence
caaaaccaactactagagtactcca

SEQ ID NO: 249387 - DNA, 25 bp, Artificial sequence
  SiRNA target sequence
aaaaccaactactagagtactccac

SEQ ID NO: 249388 - DNA, 25 bp, Artificial sequence
  SiRNA target sequence
aaaccaactactagagtactccaca

SEQ ID NO: 249389 - DNA, 25 bp, Artificial sequence
  SiRNA target sequence
aaccaactactagagtactccacaa

SEQ ID NO: 249390 - DNA, 25 bp, Artificial sequence
  SiRNA target sequence
accaactactagagtactccacaac

SEQ ID NO: 249391 - DNA, 25 bp, Artificial sequence
  SiRNA target sequence
ccaactactagagtactccacaact

SEQ ID NO: 249392 - DNA, 25 bp, Artificial sequence
  SiRNA target sequence
caactactagagtactccacaactc

SEQ ID NO: 249393 - DNA, 25 bp, Artificial sequence
  SiRNA target sequence
aactactagagtactccacaactcc

SEQ ID NO: 249394 - DNA, 25 bp, Artificial sequence
  SiRNA target sequence
actactagagtactccacaactccg

SEQ ID NO: 249395 - DNA, 25 bp, Artificial sequence
  SiRNA target sequence
ctactagagtactccacaactccga

SEQ ID NO: 249396 - DNA, 25 bp, Artificial sequence
  SiRNA target sequence
tactagagtactccacaactccgat

SEQ ID NO: 249397 - DNA, 25 bp, Artificial sequence
  SiRNA target sequence
actagagtactccacaactccgata

SEQ ID NO: 249398 - DNA, 25 bp, Artificial sequence
  SiRNA target sequence
ctagagtactccacaactccgataa

SEQ ID NO: 249399 - DNA, 25 bp, Artificial sequence
  SiRNA target sequence
tagagtactccacaactccgataag

SEQ ID NO: 249400 - DNA, 25 bp, Artificial sequence
  SiRNA target sequence
agagtactccacaactccgataaga

SEQ ID NO: 249401 - DNA, 25 bp, Artificial sequence
  SiRNA target sequence
gagtactccacaactccgataagat

SEQ ID NO: 249402 - DNA, 25 bp, Artificial sequence
  SiRNA target sequence
agtactccacaactccgataagatg

SEQ ID NO: 249403 - DNA, 25 bp, Artificial sequence
  SiRNA target sequence
gtactccacaactccgataagatgt

SEQ ID NO: 249404 - DNA, 25 bp, Artificial sequence
  SiRNA target sequence
tactccacaactccgataagatgta

SEQ ID NO: 249405 - DNA, 25 bp, Artificial sequence
  SiRNA target sequence
actccacaactccgataagatgtaa

SEQ ID NO: 249406 - DNA, 25 bp, Artificial sequence
  SiRNA target sequence
ctccacaactccgataagatgtaac

SEQ ID NO: 249407 - DNA, 25 bp, Artificial sequence
  SiRNA target sequence
tccacaactccgataagatgtaaca

SEQ ID NO: 249408 - DNA, 25 bp, Artificial sequence
  SiRNA target sequence
ccacaactccgataagatgtaacat

SEQ ID NO: 249409 - DNA, 25 bp, Artificial sequence
  SiRNA target sequence
cacaactccgataagatgtaacata

SEQ ID NO: 249410 - DNA, 25 bp, Artificial sequence
  SiRNA target sequence
acaactccgataagatgtaacataa

SEQ ID NO: 249411 - DNA, 25 bp, Artificial sequence
  SiRNA target sequence
caactccgataagatgtaacataaa

SEQ ID NO: 249412 - DNA, 25 bp, Artificial sequence
  SiRNA target sequence
aactccgataagatgtaacataaag

SEQ ID NO: 249413 - DNA, 25 bp, Artificial sequence
  SiRNA target sequence
actccgataagatgtaacataaagt

SEQ ID NO: 249414 - DNA, 25 bp, Artificial sequence
  SiRNA target sequence
ctccgataagatgtaacataaagta

SEQ ID NO: 249415 - DNA, 25 bp, Artificial sequence
  SiRNA target sequence
tccgataagatgtaacataaagtac

SEQ ID NO: 249416 - DNA, 25 bp, Artificial sequence
  SiRNA target sequence
ccgataagatgtaacataaagtact

SEQ ID NO: 249417 - DNA, 25 bp, Artificial sequence
  SiRNA target sequence
cgataagatgtaacataaagtactt

SEQ ID NO: 249418 - DNA, 25 bp, Artificial sequence
  SiRNA target sequence
gataagatgtaacataaagtactta

SEQ ID NO: 249419 - DNA, 25 bp, Artificial sequence
  SiRNA target sequence
ataagatgtaacataaagtacttat

SEQ ID NO: 249420 - DNA, 25 bp, Artificial sequence
  SiRNA target sequence
taagatgtaacataaagtacttatc

SEQ ID NO: 249421 - DNA, 25 bp, Artificial sequence
  SiRNA target sequence
aagatgtaacataaagtacttatcc

SEQ ID NO: 249422 - DNA, 25 bp, Artificial sequence
  SiRNA target sequence
agatgtaacataaagtacttatcca

SEQ ID NO: 249423 - DNA, 25 bp, Artificial sequence
  SiRNA target sequence
gatgtaacataaagtacttatccac

SEQ ID NO: 249424 - DNA, 25 bp, Artificial sequence
  SiRNA target sequence
atgtaacataaagtacttatccact

SEQ ID NO: 249425 - DNA, 25 bp, Artificial sequence
  SiRNA target sequence
tgtaacataaagtacttatccactc

SEQ ID NO: 249426 - DNA, 25 bp, Artificial sequence
  SiRNA target sequence
gtaacataaagtacttatccactca

SEQ ID NO: 249427 - DNA, 25 bp, Artificial sequence
  SiRNA target sequence
taacataaagtacttatccactcac

SEQ ID NO: 249428 - DNA, 25 bp, Artificial sequence
  SiRNA target sequence
aacataaagtacttatccactcact

SEQ ID NO: 249429 - DNA, 25 bp, Artificial sequence
  SiRNA target sequence
acataaagtacttatccactcactg

SEQ ID NO: 249430 - DNA, 25 bp, Artificial sequence
  SiRNA target sequence
cataaagtacttatccactcactgt

SEQ ID NO: 249431 - DNA, 25 bp, Artificial sequence
  SiRNA target sequence
ataaagtacttatccactcactgta

SEQ ID NO: 249432 - DNA, 25 bp, Artificial sequence
  SiRNA target sequence
taaagtacttatccactcactgtac

SEQ ID NO: 249433 - DNA, 25 bp, Artificial sequence
  SiRNA target sequence
aaagtacttatccactcactgtaca

SEQ ID NO: 249434 - DNA, 25 bp, Artificial sequence
  SiRNA target sequence
aagtacttatccactcactgtacat

SEQ ID NO: 249435 - DNA, 25 bp, Artificial sequence
  SiRNA target sequence
agtacttatccactcactgtacata

SEQ ID NO: 249436 - DNA, 25 bp, Artificial sequence
  SiRNA target sequence
gtacttatccactcactgtacatat

SEQ ID NO: 249437 - DNA, 25 bp, Artificial sequence
  SiRNA target sequence
tacttatccactcactgtacatata

SEQ ID NO: 249438 - DNA, 25 bp, Artificial sequence
  SiRNA target sequence
acttatccactcactgtacatatat

SEQ ID NO: 249439 - DNA, 25 bp, Artificial sequence
  SiRNA target sequence
cttatccactcactgtacatatata

SEQ ID NO: 249440 - DNA, 25 bp, Artificial sequence
  SiRNA target sequence
ttatccactcactgtacatatataa

SEQ ID NO: 249441 - DNA, 25 bp, Artificial sequence
  SiRNA target sequence
tatccactcactgtacatatataaa

SEQ ID NO: 249442 - DNA, 25 bp, Artificial sequence
  SiRNA target sequence
atccactcactgtacatatataaaa

SEQ ID NO: 249443 - DNA, 25 bp, Artificial sequence
  SiRNA target sequence
tccactcactgtacatatataaaaa

SEQ ID NO: 249444 - DNA, 25 bp, Artificial sequence
  SiRNA target sequence
ccactcactgtacatatataaaaaa

SEQ ID NO: 249445 - DNA, 25 bp, Artificial sequence
  SiRNA target sequence
cactcactgtacatatataaaaaag

SEQ ID NO: 249446 - DNA, 25 bp, Artificial sequence
  SiRNA target sequence
actcactgtacatatataaaaaagg

SEQ ID NO: 249447 - DNA, 25 bp, Artificial sequence
  SiRNA target sequence
ctcactgtacatatataaaaaagga

SEQ ID NO: 249448 - DNA, 25 bp, Artificial sequence
  SiRNA target sequence
tcactgtacatatataaaaaaggag

SEQ ID NO: 249449 - DNA, 25 bp, Artificial sequence
  SiRNA target sequence
cactgtacatatataaaaaaggaga

SEQ ID NO: 249450 - DNA, 25 bp, Artificial sequence
  SiRNA target sequence
actgtacatatataaaaaaggagat

SEQ ID NO: 249451 - DNA, 25 bp, Artificial sequence
  SiRNA target sequence
ctgtacatatataaaaaaggagata

SEQ ID NO: 249452 - DNA, 25 bp, Artificial sequence
  SiRNA target sequence
tgtacatatataaaaaaggagataa

SEQ ID NO: 249453 - DNA, 25 bp, Artificial sequence
  SiRNA target sequence
gtacatatataaaaaaggagataag

SEQ ID NO: 249454 - DNA, 25 bp, Artificial sequence
  SiRNA target sequence
tacatatataaaaaaggagataagc

SEQ ID NO: 249455 - DNA, 25 bp, Artificial sequence
  SiRNA target sequence
acatatataaaaaaggagataagcc

SEQ ID NO: 249456 - DNA, 25 bp, Artificial sequence
  SiRNA target sequence
catatataaaaaaggagataagccc

SEQ ID NO: 249457 - DNA, 25 bp, Artificial sequence
  SiRNA target sequence
atatataaaaaaggagataagccca

SEQ ID NO: 249458 - DNA, 25 bp, Artificial sequence
  SiRNA target sequence
tatataaaaaaggagataagcccat

SEQ ID NO: 249459 - DNA, 25 bp, Artificial sequence
  SiRNA target sequence
atataaaaaaggagataagcccatc

SEQ ID NO: 249460 - DNA, 25 bp, Artificial sequence
  SiRNA target sequence
tataaaaaaggagataagcccatca

SEQ ID NO: 249461 - DNA, 25 bp, Artificial sequence
  SiRNA target sequence
ataaaaaaggagataagcccatcaa

SEQ ID NO: 249462 - DNA, 25 bp, Artificial sequence
  SiRNA target sequence
taaaaaaggagataagcccatcaag

SEQ ID NO: 249463 - DNA, 25 bp, Artificial sequence
  SiRNA target sequence
aaaaaaggagataagcccatcaagc

SEQ ID NO: 249464 - DNA, 25 bp, Artificial sequence
  SiRNA target sequence
aaaaaggagataagcccatcaagct

SEQ ID NO: 249465 - DNA, 25 bp, Artificial sequence
  SiRNA target sequence
aaaaggagataagcccatcaagctt

SEQ ID NO: 249466 - DNA, 25 bp, Artificial sequence
  SiRNA target sequence
aaaggagataagcccatcaagcttc

SEQ ID NO: 249467 - DNA, 25 bp, Artificial sequence
  SiRNA target sequence
aaggagataagcccatcaagcttct

SEQ ID NO: 249468 - DNA, 25 bp, Artificial sequence
  SiRNA target sequence
aggagataagcccatcaagcttcta

SEQ ID NO: 249469 - DNA, 25 bp, Artificial sequence
  SiRNA target sequence
ggagataagcccatcaagcttctaa

SEQ ID NO: 249470 - DNA, 25 bp, Artificial sequence
  SiRNA target sequence
gagataagcccatcaagcttctaac

SEQ ID NO: 249471 - DNA, 25 bp, Artificial sequence
  SiRNA target sequence
agataagcccatcaagcttctaact

SEQ ID NO: 249472 - DNA, 25 bp, Artificial sequence
  SiRNA target sequence
gataagcccatcaagcttctaactg

SEQ ID NO: 249473 - DNA, 25 bp, Artificial sequence
  SiRNA target sequence
ataagcccatcaagcttctaactga

SEQ ID NO: 249474 - DNA, 25 bp, Artificial sequence
  SiRNA target sequence
taagcccatcaagcttctaactgac

SEQ ID NO: 249475 - DNA, 25 bp, Artificial sequence
  SiRNA target sequence
aagcccatcaagcttctaactgaca

SEQ ID NO: 249476 - DNA, 25 bp, Artificial sequence
  SiRNA target sequence
agcccatcaagcttctaactgacat

SEQ ID NO: 249477 - DNA, 25 bp, Artificial sequence
  SiRNA target sequence
gcccatcaagcttctaactgacatc

SEQ ID NO: 249478 - DNA, 25 bp, Artificial sequence
  SiRNA target sequence
cccatcaagcttctaactgacatct

SEQ ID NO: 249479 - DNA, 25 bp, Artificial sequence
  SiRNA target sequence
ccatcaagcttctaactgacatctt

SEQ ID NO: 249480 - DNA, 25 bp, Artificial sequence
  SiRNA target sequence
catcaagcttctaactgacatctta

SEQ ID NO: 249481 - DNA, 25 bp, Artificial sequence
  SiRNA target sequence
atcaagcttctaactgacatcttac

SEQ ID NO: 249482 - DNA, 25 bp, Artificial sequence
  SiRNA target sequence
tcaagcttctaactgacatcttacc

SEQ ID NO: 249483 - DNA, 25 bp, Artificial sequence
  SiRNA target sequence
caagcttctaactgacatcttacca

SEQ ID NO: 249484 - DNA, 25 bp, Artificial sequence
  SiRNA target sequence
aagcttctaactgacatcttaccat

SEQ ID NO: 249485 - DNA, 25 bp, Artificial sequence
  SiRNA target sequence
agcttctaactgacatcttaccatc

SEQ ID NO: 249486 - DNA, 25 bp, Artificial sequence
  SiRNA target sequence
gcttctaactgacatcttaccatca

SEQ ID NO: 249487 - DNA, 25 bp, Artificial sequence
  SiRNA target sequence
cttctaactgacatcttaccatcac

SEQ ID NO: 249488 - DNA, 25 bp, Artificial sequence
  SiRNA target sequence
ttctaactgacatcttaccatcaca

SEQ ID NO: 249489 - DNA, 25 bp, Artificial sequence
  SiRNA target sequence
tctaactgacatcttaccatcacaa

SEQ ID NO: 249490 - DNA, 25 bp, Artificial sequence
  SiRNA target sequence
ctaactgacatcttaccatcacaaa

SEQ ID NO: 249491 - DNA, 25 bp, Artificial sequence
  SiRNA target sequence
taactgacatcttaccatcacaaaa

SEQ ID NO: 249492 - DNA, 25 bp, Artificial sequence
  SiRNA target sequence
aactgacatcttaccatcacaaaaa

SEQ ID NO: 249493 - DNA, 25 bp, Artificial sequence
  SiRNA target sequence
actgacatcttaccatcacaaaaaa

SEQ ID NO: 249494 - DNA, 25 bp, Artificial sequence
  SiRNA target sequence
ctgacatcttaccatcacaaaaaat

SEQ ID NO: 249495 - DNA, 25 bp, Artificial sequence
  SiRNA target sequence
tgacatcttaccatcacaaaaaata

SEQ ID NO: 249496 - DNA, 25 bp, Artificial sequence
  SiRNA target sequence
gacatcttaccatcacaaaaaatat

SEQ ID NO: 249497 - DNA, 25 bp, Artificial sequence
  SiRNA target sequence
acatcttaccatcacaaaaaatatc

SEQ ID NO: 249498 - DNA, 25 bp, Artificial sequence
  SiRNA target sequence
catcttaccatcacaaaaaatatct

SEQ ID NO: 249499 - DNA, 25 bp, Artificial sequence
  SiRNA target sequence
atcttaccatcacaaaaaatatcta

SEQ ID NO: 249500 - DNA, 25 bp, Artificial sequence
  SiRNA target sequence
tcttaccatcacaaaaaatatctag

SEQ ID NO: 249501 - DNA, 25 bp, Artificial sequence
  SiRNA target sequence
cttaccatcacaaaaaatatctagt

SEQ ID NO: 249502 - DNA, 25 bp, Artificial sequence
  SiRNA target sequence
ttaccatcacaaaaaatatctagtg

SEQ ID NO: 249503 - DNA, 25 bp, Artificial sequence
  SiRNA target sequence
taccatcacaaaaaatatctagtgc

SEQ ID NO: 249504 - DNA, 25 bp, Artificial sequence
  SiRNA target sequence
accatcacaaaaaatatctagtgcc

SEQ ID NO: 249505 - DNA, 25 bp, Artificial sequence
  SiRNA target sequence
ccatcacaaaaaatatctagtgccc

SEQ ID NO: 249506 - DNA, 25 bp, Artificial sequence
  SiRNA target sequence
catcacaaaaaatatctagtgccca

SEQ ID NO: 249507 - DNA, 25 bp, Artificial sequence
  SiRNA target sequence
atcacaaaaaatatctagtgcccat

SEQ ID NO: 249508 - DNA, 25 bp, Artificial sequence
  SiRNA target sequence
tcacaaaaaatatctagtgcccatt

SEQ ID NO: 249509 - DNA, 25 bp, Artificial sequence
  SiRNA target sequence
cacaaaaaatatctagtgcccattg

SEQ ID NO: 249510 - DNA, 25 bp, Artificial sequence
  SiRNA target sequence
acaaaaaatatctagtgcccattgt

SEQ ID NO: 249511 - DNA, 25 bp, Artificial sequence
  SiRNA target sequence
caaaaaatatctagtgcccattgtg

SEQ ID NO: 249512 - DNA, 25 bp, Artificial sequence
  SiRNA target sequence
aaaaaatatctagtgcccattgtga

SEQ ID NO: 249513 - DNA, 25 bp, Artificial sequence
  SiRNA target sequence
aaaaatatctagtgcccattgtgat

SEQ ID NO: 249514 - DNA, 25 bp, Artificial sequence
  SiRNA target sequence
aaaatatctagtgcccattgtgatc

SEQ ID NO: 249515 - DNA, 25 bp, Artificial sequence
  SiRNA target sequence
aaatatctagtgcccattgtgatcc

SEQ ID NO: 249516 - DNA, 25 bp, Artificial sequence
  SiRNA target sequence
aatatctagtgcccattgtgatcct

SEQ ID NO: 249517 - DNA, 25 bp, Artificial sequence
  SiRNA target sequence
atatctagtgcccattgtgatcctt

SEQ ID NO: 249518 - DNA, 25 bp, Artificial sequence
  SiRNA target sequence
tatctagtgcccattgtgatccttt

SEQ ID NO: 249519 - DNA, 25 bp, Artificial sequence
  SiRNA target sequence
atctagtgcccattgtgatcctttt

SEQ ID NO: 249520 - DNA, 25 bp, Artificial sequence
  SiRNA target sequence
tctagtgcccattgtgatccttttt

SEQ ID NO: 249521 - DNA, 25 bp, Artificial sequence
  SiRNA target sequence
ctagtgcccattgtgatcctttttg

SEQ ID NO: 249522 - DNA, 25 bp, Artificial sequence
  SiRNA target sequence
tagtgcccattgtgatcctttttgg

SEQ ID NO: 249523 - DNA, 25 bp, Artificial sequence
  SiRNA target sequence
agtgcccattgtgatcctttttgga

SEQ ID NO: 249524 - DNA, 25 bp, Artificial sequence
  SiRNA target sequence
gtgcccattgtgatcctttttggat

SEQ ID NO: 249525 - DNA, 25 bp, Artificial sequence
  SiRNA target sequence
tgcccattgtgatcctttttggatt

SEQ ID NO: 249526 - DNA, 25 bp, Artificial sequence
  SiRNA target sequence
gcccattgtgatcctttttggattt

SEQ ID NO: 249527 - DNA, 25 bp, Artificial sequence
  SiRNA target sequence
cccattgtgatcctttttggatttt

SEQ ID NO: 249528 - DNA, 25 bp, Artificial sequence
  SiRNA target sequence
ccattgtgatcctttttggatttta

SEQ ID NO: 249529 - DNA, 25 bp, Artificial sequence
  SiRNA target sequence
cattgtgatcctttttggattttat

SEQ ID NO: 249530 - DNA, 25 bp, Artificial sequence
  SiRNA target sequence
attgtgatcctttttggattttata

SEQ ID NO: 249531 - DNA, 25 bp, Artificial sequence
  SiRNA target sequence
ttgtgatcctttttggattttatat

SEQ ID NO: 249532 - DNA, 25 bp, Artificial sequence
  SiRNA target sequence
tgtgatcctttttggattttatatt

SEQ ID NO: 249533 - DNA, 25 bp, Artificial sequence
  SiRNA target sequence
gtgatcctttttggattttatattc

SEQ ID NO: 249534 - DNA, 25 bp, Artificial sequence
  SiRNA target sequence
tgatcctttttggattttatattca

SEQ ID NO: 249535 - DNA, 25 bp, Artificial sequence
  SiRNA target sequence
gatcctttttggattttatattcaa

SEQ ID NO: 249536 - DNA, 25 bp, Artificial sequence
  SiRNA target sequence
atcctttttggattttatattcaaa

SEQ ID NO: 249537 - DNA, 25 bp, Artificial sequence
  SiRNA target sequence
tcctttttggattttatattcaaat

SEQ ID NO: 249538 - DNA, 25 bp, Artificial sequence
  SiRNA target sequence
cctttttggattttatattcaaatg

SEQ ID NO: 249539 - DNA, 25 bp, Artificial sequence
  SiRNA target sequence
ctttttggattttatattcaaatgg

SEQ ID NO: 249540 - DNA, 25 bp, Artificial sequence
  SiRNA target sequence
tttttggattttatattcaaatgga

SEQ ID NO: 249541 - DNA, 25 bp, Artificial sequence
  SiRNA target sequence
ttttggattttatattcaaatggaa

SEQ ID NO: 249542 - DNA, 25 bp, Artificial sequence
  SiRNA target sequence
tttggattttatattcaaatggaat

SEQ ID NO: 249543 - DNA, 25 bp, Artificial sequence
  SiRNA target sequence
ttggattttatattcaaatggaatt

SEQ ID NO: 249544 - DNA, 25 bp, Artificial sequence
  SiRNA target sequence
tggattttatattcaaatggaatta

SEQ ID NO: 249545 - DNA, 25 bp, Artificial sequence
  SiRNA target sequence
ggattttatattcaaatggaattaa

SEQ ID NO: 249546 - DNA, 25 bp, Artificial sequence
  SiRNA target sequence
gattttatattcaaatggaattaaa

SEQ ID NO: 249547 - DNA, 25 bp, Artificial sequence
  SiRNA target sequence
attttatattcaaatggaattaaaa

SEQ ID NO: 249548 - DNA, 25 bp, Artificial sequence
  SiRNA target sequence
ttttatattcaaatggaattaaaag

SEQ ID NO: 249549 - DNA, 25 bp, Artificial sequence
  SiRNA target sequence
tttatattcaaatggaattaaaaga

SEQ ID NO: 249550 - DNA, 25 bp, Artificial sequence
  SiRNA target sequence
ttatattcaaatggaattaaaagag

SEQ ID NO: 249551 - DNA, 25 bp, Artificial sequence
  SiRNA target sequence
tatattcaaatggaattaaaagaga

SEQ ID NO: 249552 - DNA, 25 bp, Artificial sequence
  SiRNA target sequence
atattcaaatggaattaaaagagaa

SEQ ID NO: 249553 - DNA, 25 bp, Artificial sequence
  SiRNA target sequence
tattcaaatggaattaaaagagaac

SEQ ID NO: 249554 - DNA, 25 bp, Artificial sequence
  SiRNA target sequence
attcaaatggaattaaaagagaacc

SEQ ID NO: 249555 - DNA, 25 bp, Artificial sequence
  SiRNA target sequence
ttcaaatggaattaaaagagaacca

SEQ ID NO: 249556 - DNA, 25 bp, Artificial sequence
  SiRNA target sequence
tcaaatggaattaaaagagaaccaa

SEQ ID NO: 249557 - DNA, 25 bp, Artificial sequence
  SiRNA target sequence
caaatggaattaaaagagaaccaat

SEQ ID NO: 249558 - DNA, 25 bp, Artificial sequence
  SiRNA target sequence
aaatggaattaaaagagaaccaatt

SEQ ID NO: 249559 - DNA, 25 bp, Artificial sequence
  SiRNA target sequence
aatggaattaaaagagaaccaatta

SEQ ID NO: 249560 - DNA, 25 bp, Artificial sequence
  SiRNA target sequence
atggaattaaaagagaaccaattag

SEQ ID NO: 249561 - DNA, 25 bp, Artificial sequence
  SiRNA target sequence
tggaattaaaagagaaccaattaga

SEQ ID NO: 249562 - DNA, 25 bp, Artificial sequence
  SiRNA target sequence
ggaattaaaagagaaccaattagaa

SEQ ID NO: 249563 - DNA, 25 bp, Artificial sequence
  SiRNA target sequence
gaattaaaagagaaccaattagaaa

SEQ ID NO: 249564 - DNA, 25 bp, Artificial sequence
  SiRNA target sequence
aattaaaagagaaccaattagaaaa

SEQ ID NO: 249565 - DNA, 25 bp, Artificial sequence
  SiRNA target sequence
attaaaagagaaccaattagaaaaa

SEQ ID NO: 249566 - DNA, 25 bp, Artificial sequence
  SiRNA target sequence
ttaaaagagaaccaattagaaaaaa

SEQ ID NO: 249567 - DNA, 25 bp, Artificial sequence
  SiRNA target sequence
taaaagagaaccaattagaaaaaaa

SEQ ID NO: 249568 - DNA, 25 bp, Artificial sequence
  SiRNA target sequence
aaaagagaaccaattagaaaaaaaa

SEQ ID NO: 249569 - DNA, 25 bp, Artificial sequence
  SiRNA target sequence
aaagagaaccaattagaaaaaaaat

SEQ ID NO: 249570 - DNA, 25 bp, Artificial sequence
  SiRNA target sequence
aagagaaccaattagaaaaaaaatg

SEQ ID NO: 249571 - DNA, 25 bp, Artificial sequence
  SiRNA target sequence
agagaaccaattagaaaaaaaatgc

SEQ ID NO: 249572 - DNA, 25 bp, Artificial sequence
  SiRNA target sequence
gagaaccaattagaaaaaaaatgcc

SEQ ID NO: 249573 - DNA, 25 bp, Artificial sequence
  SiRNA target sequence
agaaccaattagaaaaaaaatgcca

SEQ ID NO: 249574 - DNA, 25 bp, Artificial sequence
  SiRNA target sequence
gaaccaattagaaaaaaaatgccaa

SEQ ID NO: 249575 - DNA, 25 bp, Artificial sequence
  SiRNA target sequence
aaccaattagaaaaaaaatgccaat

SEQ ID NO: 249576 - DNA, 25 bp, Artificial sequence
  SiRNA target sequence
accaattagaaaaaaaatgccaata

SEQ ID NO: 249577 - DNA, 25 bp, Artificial sequence
  SiRNA target sequence
ccaattagaaaaaaaatgccaataa

SEQ ID NO: 249578 - DNA, 25 bp, Artificial sequence
  SiRNA target sequence
caattagaaaaaaaatgccaataaa

SEQ ID NO: 249579 - DNA, 25 bp, Artificial sequence
  SiRNA target sequence
aattagaaaaaaaatgccaataaaa

SEQ ID NO: 249580 - DNA, 25 bp, Artificial sequence
  SiRNA target sequence
attagaaaaaaaatgccaataaaac

SEQ ID NO: 249581 - DNA, 25 bp, Artificial sequence
  SiRNA target sequence
ttagaaaaaaaatgccaataaaacc

SEQ ID NO: 249582 - DNA, 25 bp, Artificial sequence
  SiRNA target sequence
tagaaaaaaaatgccaataaaacca

SEQ ID NO: 249583 - DNA, 25 bp, Artificial sequence
  SiRNA target sequence
agaaaaaaaatgccaataaaaccaa

SEQ ID NO: 249584 - DNA, 25 bp, Artificial sequence
  SiRNA target sequence
gaaaaaaaatgccaataaaaccaaa

SEQ ID NO: 249585 - DNA, 25 bp, Artificial sequence
  SiRNA target sequence
aaaaaaaatgccaataaaaccaaaa

SEQ ID NO: 249586 - DNA, 25 bp, Artificial sequence
  SiRNA target sequence
aaaaaaatgccaataaaaccaaaaa

SEQ ID NO: 249587 - DNA, 25 bp, Artificial sequence
  SiRNA target sequence
aaaaaatgccaataaaaccaaaaat

SEQ ID NO: 249588 - DNA, 25 bp, Artificial sequence
  SiRNA target sequence
aaaaatgccaataaaaccaaaaata

SEQ ID NO: 249589 - DNA, 25 bp, Artificial sequence
  SiRNA target sequence
aaaatgccaataaaaccaaaaataa

SEQ ID NO: 249590 - DNA, 25 bp, Artificial sequence
  SiRNA target sequence
aaatgccaataaaaccaaaaataat

SEQ ID NO: 249591 - DNA, 25 bp, Artificial sequence
  SiRNA target sequence
aatgccaataaaaccaaaaataata

SEQ ID NO: 249592 - DNA, 25 bp, Artificial sequence
  SiRNA target sequence
atgccaataaaaccaaaaataataa

SEQ ID NO: 249593 - DNA, 25 bp, Artificial sequence
  SiRNA target sequence
tgccaataaaaccaaaaataataaa

SEQ ID NO: 249594 - DNA, 25 bp, Artificial sequence
  SiRNA target sequence
gccaataaaaccaaaaataataaaa

SEQ ID NO: 249595 - DNA, 25 bp, Artificial sequence
  SiRNA target sequence
ccaataaaaccaaaaataataaaat

SEQ ID NO: 249596 - DNA, 25 bp, Artificial sequence
  SiRNA target sequence
caataaaaccaaaaataataaaatt

SEQ ID NO: 249597 - DNA, 25 bp, Artificial sequence
  SiRNA target sequence
aataaaaccaaaaataataaaattc

SEQ ID NO: 249598 - DNA, 25 bp, Artificial sequence
  SiRNA target sequence
ataaaaccaaaaataataaaattca

SEQ ID NO: 249599 - DNA, 25 bp, Artificial sequence
  SiRNA target sequence
taaaaccaaaaataataaaattcac

SEQ ID NO: 249600 - DNA, 25 bp, Artificial sequence
  SiRNA target sequence
aaaaccaaaaataataaaattcaca

SEQ ID NO: 249601 - DNA, 25 bp, Artificial sequence
  SiRNA target sequence
aaaccaaaaataataaaattcacaa

SEQ ID NO: 249602 - DNA, 25 bp, Artificial sequence
  SiRNA target sequence
aaccaaaaataataaaattcacaat

SEQ ID NO: 249603 - DNA, 25 bp, Artificial sequence
  SiRNA target sequence
accaaaaataataaaattcacaata

SEQ ID NO: 249604 - DNA, 25 bp, Artificial sequence
  SiRNA target sequence
ccaaaaataataaaattcacaatac

SEQ ID NO: 249605 - DNA, 25 bp, Artificial sequence
  SiRNA target sequence
caaaaataataaaattcacaatact

SEQ ID NO: 249606 - DNA, 25 bp, Artificial sequence
  SiRNA target sequence
aaaaataataaaattcacaatacta

SEQ ID NO: 249607 - DNA, 25 bp, Artificial sequence
  SiRNA target sequence
aaaataataaaattcacaatactaa

SEQ ID NO: 249608 - DNA, 25 bp, Artificial sequence
  SiRNA target sequence
aaataataaaattcacaatactaag

SEQ ID NO: 249609 - DNA, 25 bp, Artificial sequence
  SiRNA target sequence
aataataaaattcacaatactaaga

SEQ ID NO: 249610 - DNA, 25 bp, Artificial sequence
  SiRNA target sequence
ataataaaattcacaatactaagaa

SEQ ID NO: 249611 - DNA, 25 bp, Artificial sequence
  SiRNA target sequence
taataaaattcacaatactaagaat

SEQ ID NO: 249612 - DNA, 25 bp, Artificial sequence
  SiRNA target sequence
aataaaattcacaatactaagaata

SEQ ID NO: 249613 - DNA, 25 bp, Artificial sequence
  SiRNA target sequence
ataaaattcacaatactaagaatag

SEQ ID NO: 249614 - DNA, 25 bp, Artificial sequence
  SiRNA target sequence
taaaattcacaatactaagaataga

SEQ ID NO: 249615 - DNA, 25 bp, Artificial sequence
  SiRNA target sequence
aaaattcacaatactaagaatagag

SEQ ID NO: 249616 - DNA, 25 bp, Artificial sequence
  SiRNA target sequence
aaattcacaatactaagaatagagt

SEQ ID NO: 249617 - DNA, 25 bp, Artificial sequence
  SiRNA target sequence
aattcacaatactaagaatagagta

SEQ ID NO: 249618 - DNA, 25 bp, Artificial sequence
  SiRNA target sequence
attcacaatactaagaatagagtac

SEQ ID NO: 249619 - DNA, 25 bp, Artificial sequence
  SiRNA target sequence
ttcacaatactaagaatagagtaca

SEQ ID NO: 249620 - DNA, 25 bp, Artificial sequence
  SiRNA target sequence
tcacaatactaagaatagagtacac

SEQ ID NO: 249621 - DNA, 25 bp, Artificial sequence
  SiRNA target sequence
cacaatactaagaatagagtacaca

SEQ ID NO: 249622 - DNA, 25 bp, Artificial sequence
  SiRNA target sequence
acaatactaagaatagagtacacat

SEQ ID NO: 249623 - DNA, 25 bp, Artificial sequence
  SiRNA target sequence
caatactaagaatagagtacacatt

SEQ ID NO: 249624 - DNA, 25 bp, Artificial sequence
  SiRNA target sequence
aatactaagaatagagtacacattt

SEQ ID NO: 249625 - DNA, 25 bp, Artificial sequence
  SiRNA target sequence
atactaagaatagagtacacattta

SEQ ID NO: 249626 - DNA, 25 bp, Artificial sequence
  SiRNA target sequence
tactaagaatagagtacacatttaa

SEQ ID NO: 249627 - DNA, 25 bp, Artificial sequence
  SiRNA target sequence
actaagaatagagtacacatttaaa

SEQ ID NO: 249628 - DNA, 25 bp, Artificial sequence
  SiRNA target sequence
ctaagaatagagtacacatttaaag

SEQ ID NO: 249629 - DNA, 25 bp, Artificial sequence
  SiRNA target sequence
taagaatagagtacacatttaaagc

SEQ ID NO: 249630 - DNA, 25 bp, Artificial sequence
  SiRNA target sequence
aagaatagagtacacatttaaagcc

SEQ ID NO: 249631 - DNA, 25 bp, Artificial sequence
  SiRNA target sequence
agaatagagtacacatttaaagcct

SEQ ID NO: 249632 - DNA, 25 bp, Artificial sequence
  SiRNA target sequence
gaatagagtacacatttaaagcctt

SEQ ID NO: 249633 - DNA, 25 bp, Artificial sequence
  SiRNA target sequence
aatagagtacacatttaaagccttt

SEQ ID NO: 249634 - DNA, 25 bp, Artificial sequence
  SiRNA target sequence
atagagtacacatttaaagcctttt

SEQ ID NO: 249635 - DNA, 25 bp, Artificial sequence
  SiRNA target sequence
tagagtacacatttaaagccttttg

SEQ ID NO: 249636 - DNA, 25 bp, Artificial sequence
  SiRNA target sequence
agagtacacatttaaagccttttgg

SEQ ID NO: 249637 - DNA, 25 bp, Artificial sequence
  SiRNA target sequence
gagtacacatttaaagccttttgga

SEQ ID NO: 249638 - DNA, 25 bp, Artificial sequence
  SiRNA target sequence
agtacacatttaaagccttttggac

SEQ ID NO: 249639 - DNA, 25 bp, Artificial sequence
  SiRNA target sequence
gtacacatttaaagccttttggaca

SEQ ID NO: 249640 - DNA, 25 bp, Artificial sequence
  SiRNA target sequence
tacacatttaaagccttttggacat

SEQ ID NO: 249641 - DNA, 25 bp, Artificial sequence
  SiRNA target sequence
acacatttaaagccttttggacata

SEQ ID NO: 249642 - DNA, 25 bp, Artificial sequence
  SiRNA target sequence
cacatttaaagccttttggacatat

SEQ ID NO: 249643 - DNA, 25 bp, Artificial sequence
  SiRNA target sequence
acatttaaagccttttggacatatg

SEQ ID NO: 249644 - DNA, 25 bp, Artificial sequence
  SiRNA target sequence
catttaaagccttttggacatatga

SEQ ID NO: 249645 - DNA, 25 bp, Artificial sequence
  SiRNA target sequence
atttaaagccttttggacatatgac

SEQ ID NO: 249646 - DNA, 25 bp, Artificial sequence
  SiRNA target sequence
tttaaagccttttggacatatgaca

SEQ ID NO: 249647 - DNA, 25 bp, Artificial sequence
  SiRNA target sequence
ttaaagccttttggacatatgacat

SEQ ID NO: 249648 - DNA, 25 bp, Artificial sequence
  SiRNA target sequence
taaagccttttggacatatgacatc

SEQ ID NO: 249649 - DNA, 25 bp, Artificial sequence
  SiRNA target sequence
aaagccttttggacatatgacatca

SEQ ID NO: 249650 - DNA, 25 bp, Artificial sequence
  SiRNA target sequence
aagccttttggacatatgacatcat

SEQ ID NO: 249651 - DNA, 25 bp, Artificial sequence
  SiRNA target sequence
agccttttggacatatgacatcata

SEQ ID NO: 249652 - DNA, 25 bp, Artificial sequence
  SiRNA target sequence
gccttttggacatatgacatcataa

SEQ ID NO: 249653 - DNA, 25 bp, Artificial sequence
  SiRNA target sequence
ccttttggacatatgacatcataag

SEQ ID NO: 249654 - DNA, 25 bp, Artificial sequence
  SiRNA target sequence
cttttggacatatgacatcataaga

SEQ ID NO: 249655 - DNA, 25 bp, Artificial sequence
  SiRNA target sequence
ttttggacatatgacatcataagac

SEQ ID NO: 249656 - DNA, 25 bp, Artificial sequence
  SiRNA target sequence
tttggacatatgacatcataagaca

SEQ ID NO: 249657 - DNA, 25 bp, Artificial sequence
  SiRNA target sequence
ttggacatatgacatcataagacat

SEQ ID NO: 249658 - DNA, 25 bp, Artificial sequence
  SiRNA target sequence
tggacatatgacatcataagacata

SEQ ID NO: 249659 - DNA, 25 bp, Artificial sequence
  SiRNA target sequence
ggacatatgacatcataagacatat

SEQ ID NO: 249660 - DNA, 25 bp, Artificial sequence
  SiRNA target sequence
gacatatgacatcataagacatata

SEQ ID NO: 249661 - DNA, 25 bp, Artificial sequence
  SiRNA target sequence
acatatgacatcataagacatataa

SEQ ID NO: 249662 - DNA, 25 bp, Artificial sequence
  SiRNA target sequence
catatgacatcataagacatataat

SEQ ID NO: 249663 - DNA, 25 bp, Artificial sequence
  SiRNA target sequence
atatgacatcataagacatataatt

SEQ ID NO: 249664 - DNA, 25 bp, Artificial sequence
  SiRNA target sequence
tatgacatcataagacatataattg

SEQ ID NO: 249665 - DNA, 25 bp, Artificial sequence
  SiRNA target sequence
atgacatcataagacatataattgg

SEQ ID NO: 249666 - DNA, 25 bp, Artificial sequence
  SiRNA target sequence
tgacatcataagacatataattggc

SEQ ID NO: 249667 - DNA, 25 bp, Artificial sequence
  SiRNA target sequence
gacatcataagacatataattggca

SEQ ID NO: 249668 - DNA, 25 bp, Artificial sequence
  SiRNA target sequence
acatcataagacatataattggcag

SEQ ID NO: 249669 - DNA, 25 bp, Artificial sequence
  SiRNA target sequence
catcataagacatataattggcagt

SEQ ID NO: 249670 - DNA, 25 bp, Artificial sequence
  SiRNA target sequence
atcataagacatataattggcagtg

SEQ ID NO: 249671 - DNA, 25 bp, Artificial sequence
  SiRNA target sequence
tcataagacatataattggcagtga

SEQ ID NO: 249672 - DNA, 25 bp, Artificial sequence
  SiRNA target sequence
cataagacatataattggcagtgaa

SEQ ID NO: 249673 - DNA, 25 bp, Artificial sequence
  SiRNA target sequence
ataagacatataattggcagtgaaa

SEQ ID NO: 249674 - DNA, 25 bp, Artificial sequence
  SiRNA target sequence
taagacatataattggcagtgaaaa

SEQ ID NO: 249675 - DNA, 25 bp, Artificial sequence
  SiRNA target sequence
aagacatataattggcagtgaaaag

SEQ ID NO: 249676 - DNA, 25 bp, Artificial sequence
  SiRNA target sequence
agacatataattggcagtgaaaaga

SEQ ID NO: 249677 - DNA, 25 bp, Artificial sequence
  SiRNA target sequence
gacatataattggcagtgaaaagaa

SEQ ID NO: 249678 - DNA, 25 bp, Artificial sequence
  SiRNA target sequence
acatataattggcagtgaaaagaaa

SEQ ID NO: 249679 - DNA, 25 bp, Artificial sequence
  SiRNA target sequence
catataattggcagtgaaaagaaaa

SEQ ID NO: 249680 - DNA, 25 bp, Artificial sequence
  SiRNA target sequence
atataattggcagtgaaaagaaaag

SEQ ID NO: 249681 - DNA, 25 bp, Artificial sequence
  SiRNA target sequence
tataattggcagtgaaaagaaaagc

SEQ ID NO: 249682 - DNA, 25 bp, Artificial sequence
  SiRNA target sequence
ataattggcagtgaaaagaaaagct

SEQ ID NO: 249683 - DNA, 25 bp, Artificial sequence
  SiRNA target sequence
taattggcagtgaaaagaaaagctt

SEQ ID NO: 249684 - DNA, 25 bp, Artificial sequence
  SiRNA target sequence
aattggcagtgaaaagaaaagcttt

SEQ ID NO: 249685 - DNA, 25 bp, Artificial sequence
  SiRNA target sequence
attggcagtgaaaagaaaagcttta

SEQ ID NO: 249686 - DNA, 25 bp, Artificial sequence
  SiRNA target sequence
ttggcagtgaaaagaaaagctttat

SEQ ID NO: 249687 - DNA, 25 bp, Artificial sequence
  SiRNA target sequence
tggcagtgaaaagaaaagctttatg

SEQ ID NO: 249688 - DNA, 25 bp, Artificial sequence
  SiRNA target sequence
ggcagtgaaaagaaaagctttatgt

SEQ ID NO: 249689 - DNA, 25 bp, Artificial sequence
  SiRNA target sequence
gcagtgaaaagaaaagctttatgta

SEQ ID NO: 249690 - DNA, 25 bp, Artificial sequence
  SiRNA target sequence
cagtgaaaagaaaagctttatgtag

SEQ ID NO: 249691 - DNA, 25 bp, Artificial sequence
  SiRNA target sequence
agtgaaaagaaaagctttatgtagt

SEQ ID NO: 249692 - DNA, 25 bp, Artificial sequence
  SiRNA target sequence
gtgaaaagaaaagctttatgtagta

SEQ ID NO: 249693 - DNA, 25 bp, Artificial sequence
  SiRNA target sequence
tgaaaagaaaagctttatgtagtac

SEQ ID NO: 249694 - DNA, 25 bp, Artificial sequence
  SiRNA target sequence
gaaaagaaaagctttatgtagtaca

SEQ ID NO: 249695 - DNA, 25 bp, Artificial sequence
  SiRNA target sequence
aaaagaaaagctttatgtagtacag

SEQ ID NO: 249696 - DNA, 25 bp, Artificial sequence
  SiRNA target sequence
aaagaaaagctttatgtagtacagt

SEQ ID NO: 249697 - DNA, 25 bp, Artificial sequence
  SiRNA target sequence
aagaaaagctttatgtagtacagtg

SEQ ID NO: 249698 - DNA, 25 bp, Artificial sequence
  SiRNA target sequence
agaaaagctttatgtagtacagtga

SEQ ID NO: 249699 - DNA, 25 bp, Artificial sequence
  SiRNA target sequence
gaaaagctttatgtagtacagtgac

SEQ ID NO: 249700 - DNA, 25 bp, Artificial sequence
  SiRNA target sequence
aaaagctttatgtagtacagtgacg

SEQ ID NO: 249701 - DNA, 25 bp, Artificial sequence
  SiRNA target sequence
aaagctttatgtagtacagtgacga

SEQ ID NO: 249702 - DNA, 25 bp, Artificial sequence
  SiRNA target sequence
aagctttatgtagtacagtgacgaa

SEQ ID NO: 249703 - DNA, 25 bp, Artificial sequence
  SiRNA target sequence
agctttatgtagtacagtgacgaag

SEQ ID NO: 249704 - DNA, 25 bp, Artificial sequence
  SiRNA target sequence
gctttatgtagtacagtgacgaagg

SEQ ID NO: 249705 - DNA, 25 bp, Artificial sequence
  SiRNA target sequence
ctttatgtagtacagtgacgaagga

SEQ ID NO: 249706 - DNA, 25 bp, Artificial sequence
  SiRNA target sequence
tttatgtagtacagtgacgaaggaa

SEQ ID NO: 249707 - DNA, 25 bp, Artificial sequence
  SiRNA target sequence
ttatgtagtacagtgacgaaggaat

SEQ ID NO: 249708 - DNA, 25 bp, Artificial sequence
  SiRNA target sequence
tatgtagtacagtgacgaaggaatt

SEQ ID NO: 249709 - DNA, 25 bp, Artificial sequence
  SiRNA target sequence
atgtagtacagtgacgaaggaattt

SEQ ID NO: 249710 - DNA, 25 bp, Artificial sequence
  SiRNA target sequence
tgtagtacagtgacgaaggaatttg

SEQ ID NO: 249711 - DNA, 25 bp, Artificial sequence
  SiRNA target sequence
gtagtacagtgacgaaggaatttgt

SEQ ID NO: 249712 - DNA, 25 bp, Artificial sequence
  SiRNA target sequence
tagtacagtgacgaaggaatttgtt

SEQ ID NO: 249713 - DNA, 25 bp, Artificial sequence
  SiRNA target sequence
agtacagtgacgaaggaatttgttt

SEQ ID NO: 249714 - DNA, 25 bp, Artificial sequence
  SiRNA target sequence
gtacagtgacgaaggaatttgtttt

SEQ ID NO: 249715 - DNA, 25 bp, Artificial sequence
  SiRNA target sequence
tacagtgacgaaggaatttgttttg

SEQ ID NO: 249716 - DNA, 25 bp, Artificial sequence
  SiRNA target sequence
acagtgacgaaggaatttgttttgt

SEQ ID NO: 249717 - DNA, 25 bp, Artificial sequence
  SiRNA target sequence
cagtgacgaaggaatttgttttgtc

SEQ ID NO: 249718 - DNA, 25 bp, Artificial sequence
  SiRNA target sequence
agtgacgaaggaatttgttttgtca

SEQ ID NO: 249719 - DNA, 25 bp, Artificial sequence
  SiRNA target sequence
gtgacgaaggaatttgttttgtcat

SEQ ID NO: 249720 - DNA, 25 bp, Artificial sequence
  SiRNA target sequence
tgacgaaggaatttgttttgtcata

SEQ ID NO: 249721 - DNA, 25 bp, Artificial sequence
  SiRNA target sequence
gacgaaggaatttgttttgtcataa

SEQ ID NO: 249722 - DNA, 25 bp, Artificial sequence
  SiRNA target sequence
acgaaggaatttgttttgtcataat

SEQ ID NO: 249723 - DNA, 25 bp, Artificial sequence
  SiRNA target sequence
cgaaggaatttgttttgtcataatc

SEQ ID NO: 249724 - DNA, 25 bp, Artificial sequence
  SiRNA target sequence
gaaggaatttgttttgtcataatca

SEQ ID NO: 249725 - DNA, 25 bp, Artificial sequence
  SiRNA target sequence
aaggaatttgttttgtcataatcac

SEQ ID NO: 249726 - DNA, 25 bp, Artificial sequence
  SiRNA target sequence
aggaatttgttttgtcataatcacg

SEQ ID NO: 249727 - DNA, 25 bp, Artificial sequence
  SiRNA target sequence
ggaatttgttttgtcataatcacga

SEQ ID NO: 249728 - DNA, 25 bp, Artificial sequence
  SiRNA target sequence
gaatttgttttgtcataatcacgat

SEQ ID NO: 249729 - DNA, 25 bp, Artificial sequence
  SiRNA target sequence
aatttgttttgtcataatcacgatt

SEQ ID NO: 249730 - DNA, 25 bp, Artificial sequence
  SiRNA target sequence
atttgttttgtcataatcacgattt

SEQ ID NO: 249731 - DNA, 25 bp, Artificial sequence
  SiRNA target sequence
tttgttttgtcataatcacgatttc

SEQ ID NO: 249732 - DNA, 25 bp, Artificial sequence
  SiRNA target sequence
ttgttttgtcataatcacgatttct

SEQ ID NO: 249733 - DNA, 25 bp, Artificial sequence
  SiRNA target sequence
tgttttgtcataatcacgatttctc

SEQ ID NO: 249734 - DNA, 25 bp, Artificial sequence
  SiRNA target sequence
gttttgtcataatcacgatttctct

SEQ ID NO: 249735 - DNA, 25 bp, Artificial sequence
  SiRNA target sequence
ttttgtcataatcacgatttctctg

SEQ ID NO: 249736 - DNA, 25 bp, Artificial sequence
  SiRNA target sequence
tttgtcataatcacgatttctctgt

SEQ ID NO: 249737 - DNA, 25 bp, Artificial sequence
  SiRNA target sequence
ttgtcataatcacgatttctctgta

SEQ ID NO: 249738 - DNA, 25 bp, Artificial sequence
  SiRNA target sequence
tgtcataatcacgatttctctgtaa

SEQ ID NO: 249739 - DNA, 25 bp, Artificial sequence
  SiRNA target sequence
gtcataatcacgatttctctgtaaa

SEQ ID NO: 249740 - DNA, 25 bp, Artificial sequence
  SiRNA target sequence
tcataatcacgatttctctgtaaaa

SEQ ID NO: 249741 - DNA, 25 bp, Artificial sequence
  SiRNA target sequence
cataatcacgatttctctgtaaaat

SEQ ID NO: 249742 - DNA, 25 bp, Artificial sequence
  SiRNA target sequence
ataatcacgatttctctgtaaaatt

SEQ ID NO: 249743 - DNA, 25 bp, Artificial sequence
  SiRNA target sequence
taatcacgatttctctgtaaaattc

SEQ ID NO: 249744 - DNA, 25 bp, Artificial sequence
  SiRNA target sequence
aatcacgatttctctgtaaaattcc

SEQ ID NO: 249745 - DNA, 25 bp, Artificial sequence
  SiRNA target sequence
atcacgatttctctgtaaaattcca

SEQ ID NO: 249746 - DNA, 25 bp, Artificial sequence
  SiRNA target sequence
tcacgatttctctgtaaaattccaa

SEQ ID NO: 249747 - DNA, 25 bp, Artificial sequence
  SiRNA target sequence
cacgatttctctgtaaaattccaat

SEQ ID NO: 249748 - DNA, 25 bp, Artificial sequence
  SiRNA target sequence
acgatttctctgtaaaattccaata

SEQ ID NO: 249749 - DNA, 25 bp, Artificial sequence
  SiRNA target sequence
cgatttctctgtaaaattccaataa

SEQ ID NO: 249750 - DNA, 25 bp, Artificial sequence
  SiRNA target sequence
gatttctctgtaaaattccaataat

SEQ ID NO: 249751 - DNA, 25 bp, Artificial sequence
  SiRNA target sequence
atttctctgtaaaattccaataatg

SEQ ID NO: 249752 - DNA, 25 bp, Artificial sequence
  SiRNA target sequence
tttctctgtaaaattccaataatgt

SEQ ID NO: 249753 - DNA, 25 bp, Artificial sequence
  SiRNA target sequence
ttctctgtaaaattccaataatgtg

SEQ ID NO: 249754 - DNA, 25 bp, Artificial sequence
  SiRNA target sequence
tctctgtaaaattccaataatgtgt

SEQ ID NO: 249755 - DNA, 25 bp, Artificial sequence
  SiRNA target sequence
ctctgtaaaattccaataatgtgtt

SEQ ID NO: 249756 - DNA, 25 bp, Artificial sequence
  SiRNA target sequence
tctgtaaaattccaataatgtgtta

SEQ ID NO: 249757 - DNA, 25 bp, Artificial sequence
  SiRNA target sequence
ctgtaaaattccaataatgtgttaa

SEQ ID NO: 249758 - DNA, 25 bp, Artificial sequence
  SiRNA target sequence
tgtaaaattccaataatgtgttaat

SEQ ID NO: 249759 - DNA, 25 bp, Artificial sequence
  SiRNA target sequence
gtaaaattccaataatgtgttaatc

SEQ ID NO: 249760 - DNA, 25 bp, Artificial sequence
  SiRNA target sequence
taaaattccaataatgtgttaatca

SEQ ID NO: 249761 - DNA, 25 bp, Artificial sequence
  SiRNA target sequence
aaaattccaataatgtgttaatcac

SEQ ID NO: 249762 - DNA, 25 bp, Artificial sequence
  SiRNA target sequence
aaattccaataatgtgttaatcaca

SEQ ID NO: 249763 - DNA, 25 bp, Artificial sequence
  SiRNA target sequence
aattccaataatgtgttaatcacac

SEQ ID NO: 249764 - DNA, 25 bp, Artificial sequence
  SiRNA target sequence
attccaataatgtgttaatcacaca

SEQ ID NO: 249765 - DNA, 25 bp, Artificial sequence
  SiRNA target sequence
ttccaataatgtgttaatcacacat

SEQ ID NO: 249766 - DNA, 25 bp, Artificial sequence
  SiRNA target sequence
tccaataatgtgttaatcacacatg

SEQ ID NO: 249767 - DNA, 25 bp, Artificial sequence
  SiRNA target sequence
ccaataatgtgttaatcacacatgc

SEQ ID NO: 249768 - DNA, 25 bp, Artificial sequence
  SiRNA target sequence
caataatgtgttaatcacacatgcc

SEQ ID NO: 249769 - DNA, 25 bp, Artificial sequence
  SiRNA target sequence
aataatgtgttaatcacacatgcca

SEQ ID NO: 249770 - DNA, 25 bp, Artificial sequence
  SiRNA target sequence
ataatgtgttaatcacacatgccat

SEQ ID NO: 249771 - DNA, 25 bp, Artificial sequence
  SiRNA target sequence
taatgtgttaatcacacatgccatt

SEQ ID NO: 249772 - DNA, 25 bp, Artificial sequence
  SiRNA target sequence
aatgtgttaatcacacatgccatta

SEQ ID NO: 249773 - DNA, 25 bp, Artificial sequence
  SiRNA target sequence
atgtgttaatcacacatgccattaa

SEQ ID NO: 249774 - DNA, 25 bp, Artificial sequence
  SiRNA target sequence
tgtgttaatcacacatgccattaaa

SEQ ID NO: 249775 - DNA, 25 bp, Artificial sequence
  SiRNA target sequence
gtgttaatcacacatgccattaaaa

SEQ ID NO: 249776 - DNA, 25 bp, Artificial sequence
  SiRNA target sequence
tgttaatcacacatgccattaaaaa

SEQ ID NO: 249777 - DNA, 25 bp, Artificial sequence
  SiRNA target sequence
gttaatcacacatgccattaaaaat

SEQ ID NO: 249778 - DNA, 25 bp, Artificial sequence
  SiRNA target sequence
ttaatcacacatgccattaaaaatg

SEQ ID NO: 249779 - DNA, 25 bp, Artificial sequence
  SiRNA target sequence
taatcacacatgccattaaaaatgt

SEQ ID NO: 249780 - DNA, 25 bp, Artificial sequence
  SiRNA target sequence
aatcacacatgccattaaaaatgta

SEQ ID NO: 249781 - DNA, 25 bp, Artificial sequence
  SiRNA target sequence
atcacacatgccattaaaaatgtaa

SEQ ID NO: 249782 - DNA, 25 bp, Artificial sequence
  SiRNA target sequence
tcacacatgccattaaaaatgtaag

SEQ ID NO: 249783 - DNA, 25 bp, Artificial sequence
  SiRNA target sequence
cacacatgccattaaaaatgtaagt

SEQ ID NO: 249784 - DNA, 25 bp, Artificial sequence
  SiRNA target sequence
acacatgccattaaaaatgtaagtg

SEQ ID NO: 249785 - DNA, 25 bp, Artificial sequence
  SiRNA target sequence
cacatgccattaaaaatgtaagtga

SEQ ID NO: 249786 - DNA, 25 bp, Artificial sequence
  SiRNA target sequence
acatgccattaaaaatgtaagtgac

SEQ ID NO: 249787 - DNA, 25 bp, Artificial sequence
  SiRNA target sequence
catgccattaaaaatgtaagtgaca

SEQ ID NO: 249788 - DNA, 25 bp, Artificial sequence
  SiRNA target sequence
atgccattaaaaatgtaagtgacaa

SEQ ID NO: 249789 - DNA, 25 bp, Artificial sequence
  SiRNA target sequence
tgccattaaaaatgtaagtgacaat

SEQ ID NO: 249790 - DNA, 25 bp, Artificial sequence
  SiRNA target sequence
gccattaaaaatgtaagtgacaata

SEQ ID NO: 249791 - DNA, 25 bp, Artificial sequence
  SiRNA target sequence
ccattaaaaatgtaagtgacaataa

SEQ ID NO: 249792 - DNA, 25 bp, Artificial sequence
  SiRNA target sequence
cattaaaaatgtaagtgacaataat

SEQ ID NO: 249793 - DNA, 25 bp, Artificial sequence
  SiRNA target sequence
attaaaaatgtaagtgacaataata

SEQ ID NO: 249794 - DNA, 25 bp, Artificial sequence
  SiRNA target sequence
ttaaaaatgtaagtgacaataatat

SEQ ID NO: 249795 - DNA, 25 bp, Artificial sequence
  SiRNA target sequence
taaaaatgtaagtgacaataatatt

SEQ ID NO: 249796 - DNA, 25 bp, Artificial sequence
  SiRNA target sequence
aaaaatgtaagtgacaataatattt

SEQ ID NO: 249797 - DNA, 25 bp, Artificial sequence
  SiRNA target sequence
aaaatgtaagtgacaataatatttt

SEQ ID NO: 249798 - DNA, 25 bp, Artificial sequence
  SiRNA target sequence
aaatgtaagtgacaataatattttt

SEQ ID NO: 249799 - DNA, 25 bp, Artificial sequence
  SiRNA target sequence
aatgtaagtgacaataatattttta

SEQ ID NO: 249800 - DNA, 25 bp, Artificial sequence
  SiRNA target sequence
atgtaagtgacaataatatttttac

SEQ ID NO: 249801 - DNA, 25 bp, Artificial sequence
  SiRNA target sequence
tgtaagtgacaataatatttttact

SEQ ID NO: 249802 - DNA, 25 bp, Artificial sequence
  SiRNA target sequence
gtaagtgacaataatatttttactt

SEQ ID NO: 249803 - DNA, 25 bp, Artificial sequence
  SiRNA target sequence
taagtgacaataatatttttacttt

SEQ ID NO: 249804 - DNA, 25 bp, Artificial sequence
  SiRNA target sequence
aagtgacaataatatttttactttt

SEQ ID NO: 249805 - DNA, 25 bp, Artificial sequence
  SiRNA target sequence
agtgacaataatatttttacttttg

SEQ ID NO: 249806 - DNA, 25 bp, Artificial sequence
  SiRNA target sequence
gtgacaataatatttttacttttgg

SEQ ID NO: 249807 - DNA, 25 bp, Artificial sequence
  SiRNA target sequence
tgacaataatatttttacttttggg

SEQ ID NO: 249808 - DNA, 25 bp, Artificial sequence
  SiRNA target sequence
gacaataatatttttacttttggga

SEQ ID NO: 249809 - DNA, 25 bp, Artificial sequence
  SiRNA target sequence
acaataatatttttacttttgggaa

SEQ ID NO: 249810 - DNA, 25 bp, Artificial sequence
  SiRNA target sequence
caataatatttttacttttgggaat

SEQ ID NO: 249811 - DNA, 25 bp, Artificial sequence
  SiRNA target sequence
aataatatttttacttttgggaatt

SEQ ID NO: 249812 - DNA, 25 bp, Artificial sequence
  SiRNA target sequence
ataatatttttacttttgggaattt

SEQ ID NO: 249813 - DNA, 25 bp, Artificial sequence
  SiRNA target sequence
taatatttttacttttgggaatttt

SEQ ID NO: 249814 - DNA, 25 bp, Artificial sequence
  SiRNA target sequence
aatatttttacttttgggaattttt

SEQ ID NO: 249815 - DNA, 25 bp, Artificial sequence
  SiRNA target sequence
atatttttacttttgggaatttttt

SEQ ID NO: 249816 - DNA, 25 bp, Artificial sequence
  SiRNA target sequence
tatttttacttttgggaattttttt

SEQ ID NO: 249817 - DNA, 25 bp, Artificial sequence
  SiRNA target sequence
atttttacttttgggaatttttttg

SEQ ID NO: 249818 - DNA, 25 bp, Artificial sequence
  SiRNA target sequence
tttttacttttgggaatttttttgt

SEQ ID NO: 249819 - DNA, 25 bp, Artificial sequence
  SiRNA target sequence
ttttacttttgggaatttttttgtc

SEQ ID NO: 249820 - DNA, 25 bp, Artificial sequence
  SiRNA target sequence
tttacttttgggaatttttttgtct

SEQ ID NO: 249821 - DNA, 25 bp, Artificial sequence
  SiRNA target sequence
ttacttttgggaatttttttgtctt

SEQ ID NO: 249822 - DNA, 25 bp, Artificial sequence
  SiRNA target sequence
tacttttgggaatttttttgtctta

SEQ ID NO: 249823 - DNA, 25 bp, Artificial sequence
  SiRNA target sequence
acttttgggaatttttttgtcttag

SEQ ID NO: 249824 - DNA, 25 bp, Artificial sequence
  SiRNA target sequence
cttttgggaatttttttgtcttagt

SEQ ID NO: 249825 - DNA, 25 bp, Artificial sequence
  SiRNA target sequence
ttttgggaatttttttgtcttagtc

SEQ ID NO: 249826 - DNA, 25 bp, Artificial sequence
  SiRNA target sequence
tttgggaatttttttgtcttagtca

SEQ ID NO: 249827 - DNA, 25 bp, Artificial sequence
  SiRNA target sequence
ttgggaatttttttgtcttagtcat

SEQ ID NO: 249828 - DNA, 26 bp, Artificial sequence
  SiRNA target sequence
ttaattaaaatcaacatctatctcag

SEQ ID NO: 249829 - DNA, 26 bp, Artificial sequence
  SiRNA target sequence
taattaaaatcaacatctatctcaga

SEQ ID NO: 249830 - DNA, 26 bp, Artificial sequence
  SiRNA target sequence
aattaaaatcaacatctatctcagaa

SEQ ID NO: 249831 - DNA, 26 bp, Artificial sequence
  SiRNA target sequence
attaaaatcaacatctatctcagaat

SEQ ID NO: 249832 - DNA, 26 bp, Artificial sequence
  SiRNA target sequence
ttaaaatcaacatctatctcagaatt

SEQ ID NO: 249833 - DNA, 26 bp, Artificial sequence
  SiRNA target sequence
taaaatcaacatctatctcagaattt

SEQ ID NO: 249834 - DNA, 26 bp, Artificial sequence
  SiRNA target sequence
aaaatcaacatctatctcagaatttt

SEQ ID NO: 249835 - DNA, 26 bp, Artificial sequence
  SiRNA target sequence
aaatcaacatctatctcagaattttg

SEQ ID NO: 249836 - DNA, 26 bp, Artificial sequence
  SiRNA target sequence
aatcaacatctatctcagaattttgt

SEQ ID NO: 249837 - DNA, 26 bp, Artificial sequence
  SiRNA target sequence
atcaacatctatctcagaattttgtt

SEQ ID NO: 249838 - DNA, 26 bp, Artificial sequence
  SiRNA target sequence
tcaacatctatctcagaattttgttc

SEQ ID NO: 249839 - DNA, 26 bp, Artificial sequence
  SiRNA target sequence
caacatctatctcagaattttgttca

SEQ ID NO: 249840 - DNA, 26 bp, Artificial sequence
  SiRNA target sequence
aacatctatctcagaattttgttcaa

SEQ ID NO: 249841 - DNA, 26 bp, Artificial sequence
  SiRNA target sequence
acatctatctcagaattttgttcaat

SEQ ID NO: 249842 - DNA, 26 bp, Artificial sequence
  SiRNA target sequence
catctatctcagaattttgttcaatt

SEQ ID NO: 249843 - DNA, 26 bp, Artificial sequence
  SiRNA target sequence
atctatctcagaattttgttcaattg

SEQ ID NO: 249844 - DNA, 26 bp, Artificial sequence
  SiRNA target sequence
tctatctcagaattttgttcaattga

SEQ ID NO: 249845 - DNA, 26 bp, Artificial sequence
  SiRNA target sequence
ctatctcagaattttgttcaattgat

SEQ ID NO: 249846 - DNA, 26 bp, Artificial sequence
  SiRNA target sequence
tatctcagaattttgttcaattgatt

SEQ ID NO: 249847 - DNA, 26 bp, Artificial sequence
  SiRNA target sequence
atctcagaattttgttcaattgattc

SEQ ID NO: 249848 - DNA, 26 bp, Artificial sequence
  SiRNA target sequence
tctcagaattttgttcaattgattca

SEQ ID NO: 249849 - DNA, 26 bp, Artificial sequence
  SiRNA target sequence
ctcagaattttgttcaattgattcat

SEQ ID NO: 249850 - DNA, 26 bp, Artificial sequence
  SiRNA target sequence
tcagaattttgttcaattgattcatt

SEQ ID NO: 249851 - DNA, 26 bp, Artificial sequence
  SiRNA target sequence
cagaattttgttcaattgattcatta

SEQ ID NO: 249852 - DNA, 26 bp, Artificial sequence
  SiRNA target sequence
agaattttgttcaattgattcattat

SEQ ID NO: 249853 - DNA, 26 bp, Artificial sequence
  SiRNA target sequence
gaattttgttcaattgattcattata

SEQ ID NO: 249854 - DNA, 26 bp, Artificial sequence
  SiRNA target sequence
aattttgttcaattgattcattatat

SEQ ID NO: 249855 - DNA, 26 bp, Artificial sequence
  SiRNA target sequence
attttgttcaattgattcattatatt

SEQ ID NO: 249856 - DNA, 26 bp, Artificial sequence
  SiRNA target sequence
ttttgttcaattgattcattatattt

SEQ ID NO: 249857 - DNA, 26 bp, Artificial sequence
  SiRNA target sequence
tttgttcaattgattcattatatttt

SEQ ID NO: 249858 - DNA, 26 bp, Artificial sequence
  SiRNA target sequence
ttgttcaattgattcattatattttt

SEQ ID NO: 249859 - DNA, 26 bp, Artificial sequence
  SiRNA target sequence
tgttcaattgattcattatatttttt

SEQ ID NO: 249860 - DNA, 26 bp, Artificial sequence
  SiRNA target sequence
gttcaattgattcattatatttttta

SEQ ID NO: 249861 - DNA, 26 bp, Artificial sequence
  SiRNA target sequence
ttcaattgattcattatattttttac

SEQ ID NO: 249862 - DNA, 26 bp, Artificial sequence
  SiRNA target sequence
tcaattgattcattatattttttact

SEQ ID NO: 249863 - DNA, 26 bp, Artificial sequence
  SiRNA target sequence
caattgattcattatattttttactt

SEQ ID NO: 249864 - DNA, 26 bp, Artificial sequence
  SiRNA target sequence
aattgattcattatattttttactta

SEQ ID NO: 249865 - DNA, 26 bp, Artificial sequence
  SiRNA target sequence
attgattcattatattttttacttaa

SEQ ID NO: 249866 - DNA, 26 bp, Artificial sequence
  SiRNA target sequence
ttgattcattatattttttacttaaa

SEQ ID NO: 249867 - DNA, 26 bp, Artificial sequence
  SiRNA target sequence
tgattcattatattttttacttaaat

SEQ ID NO: 249868 - DNA, 26 bp, Artificial sequence
  SiRNA target sequence
gattcattatattttttacttaaata

SEQ ID NO: 249869 - DNA, 26 bp, Artificial sequence
  SiRNA target sequence
attcattatattttttacttaaataa

SEQ ID NO: 249870 - DNA, 26 bp, Artificial sequence
  SiRNA target sequence
ttcattatattttttacttaaataac

SEQ ID NO: 249871 - DNA, 26 bp, Artificial sequence
  SiRNA target sequence
tcattatattttttacttaaataaca

SEQ ID NO: 249872 - DNA, 26 bp, Artificial sequence
  SiRNA target sequence
cattatattttttacttaaataacag

SEQ ID NO: 249873 - DNA, 26 bp, Artificial sequence
  SiRNA target sequence
attatattttttacttaaataacaga

SEQ ID NO: 249874 - DNA, 26 bp, Artificial sequence
  SiRNA target sequence
ttatattttttacttaaataacagac

SEQ ID NO: 249875 - DNA, 26 bp, Artificial sequence
  SiRNA target sequence
tatattttttacttaaataacagaca

SEQ ID NO: 249876 - DNA, 26 bp, Artificial sequence
  SiRNA target sequence
atattttttacttaaataacagacac

SEQ ID NO: 249877 - DNA, 26 bp, Artificial sequence
  SiRNA target sequence
tattttttacttaaataacagacact

SEQ ID NO: 249878 - DNA, 26 bp, Artificial sequence
  SiRNA target sequence
attttttacttaaataacagacactc

SEQ ID NO: 249879 - DNA, 26 bp, Artificial sequence
  SiRNA target sequence
ttttttacttaaataacagacactcc

SEQ ID NO: 249880 - DNA, 26 bp, Artificial sequence
  SiRNA target sequence
tttttacttaaataacagacactcct

SEQ ID NO: 249881 - DNA, 26 bp, Artificial sequence
  SiRNA target sequence
ttttacttaaataacagacactcctg

SEQ ID NO: 249882 - DNA, 26 bp, Artificial sequence
  SiRNA target sequence
tttacttaaataacagacactcctga

SEQ ID NO: 249883 - DNA, 26 bp, Artificial sequence
  SiRNA target sequence
ttacttaaataacagacactcctgat

SEQ ID NO: 249884 - DNA, 26 bp, Artificial sequence
  SiRNA target sequence
tacttaaataacagacactcctgatc

SEQ ID NO: 249885 - DNA, 26 bp, Artificial sequence
  SiRNA target sequence
acttaaataacagacactcctgatcc

SEQ ID NO: 249886 - DNA, 26 bp, Artificial sequence
  SiRNA target sequence
cttaaataacagacactcctgatcca

SEQ ID NO: 249887 - DNA, 26 bp, Artificial sequence
  SiRNA target sequence
ttaaataacagacactcctgatccac

SEQ ID NO: 249888 - DNA, 26 bp, Artificial sequence
  SiRNA target sequence
taaataacagacactcctgatccaca

SEQ ID NO: 249889 - DNA, 26 bp, Artificial sequence
  SiRNA target sequence
aaataacagacactcctgatccacaa

SEQ ID NO: 249890 - DNA, 26 bp, Artificial sequence
  SiRNA target sequence
aataacagacactcctgatccacaaa

SEQ ID NO: 249891 - DNA, 26 bp, Artificial sequence
  SiRNA target sequence
ataacagacactcctgatccacaaaa

SEQ ID NO: 249892 - DNA, 26 bp, Artificial sequence
  SiRNA target sequence
taacagacactcctgatccacaaaaa

SEQ ID NO: 249893 - DNA, 26 bp, Artificial sequence
  SiRNA target sequence
aacagacactcctgatccacaaaaaa

SEQ ID NO: 249894 - DNA, 26 bp, Artificial sequence
  SiRNA target sequence
acagacactcctgatccacaaaaaat

SEQ ID NO: 249895 - DNA, 26 bp, Artificial sequence
  SiRNA target sequence
cagacactcctgatccacaaaaaatt

SEQ ID NO: 249896 - DNA, 26 bp, Artificial sequence
  SiRNA target sequence
agacactcctgatccacaaaaaattt

SEQ ID NO: 249897 - DNA, 26 bp, Artificial sequence
  SiRNA target sequence
gacactcctgatccacaaaaaatttg

SEQ ID NO: 249898 - DNA, 26 bp, Artificial sequence
  SiRNA target sequence
acactcctgatccacaaaaaatttgc

SEQ ID NO: 249899 - DNA, 26 bp, Artificial sequence
  SiRNA target sequence
cactcctgatccacaaaaaatttgca

SEQ ID NO: 249900 - DNA, 26 bp, Artificial sequence
  SiRNA target sequence
actcctgatccacaaaaaatttgcaa

SEQ ID NO: 249901 - DNA, 26 bp, Artificial sequence
  SiRNA target sequence
ctcctgatccacaaaaaatttgcaaa

SEQ ID NO: 249902 - DNA, 26 bp, Artificial sequence
  SiRNA target sequence
tcctgatccacaaaaaatttgcaaat

SEQ ID NO: 249903 - DNA, 26 bp, Artificial sequence
  SiRNA target sequence
cctgatccacaaaaaatttgcaaata

SEQ ID NO: 249904 - DNA, 26 bp, Artificial sequence
  SiRNA target sequence
ctgatccacaaaaaatttgcaaatat

SEQ ID NO: 249905 - DNA, 26 bp, Artificial sequence
  SiRNA target sequence
tgatccacaaaaaatttgcaaatatt

SEQ ID NO: 249906 - DNA, 26 bp, Artificial sequence
  SiRNA target sequence
gatccacaaaaaatttgcaaatatta

SEQ ID NO: 249907 - DNA, 26 bp, Artificial sequence
  SiRNA target sequence
atccacaaaaaatttgcaaatattaa

SEQ ID NO: 249908 - DNA, 26 bp, Artificial sequence
  SiRNA target sequence
tccacaaaaaatttgcaaatattaaa

SEQ ID NO: 249909 - DNA, 26 bp, Artificial sequence
  SiRNA target sequence
ccacaaaaaatttgcaaatattaaaa

SEQ ID NO: 249910 - DNA, 26 bp, Artificial sequence
  SiRNA target sequence
cacaaaaaatttgcaaatattaaaaa

SEQ ID NO: 249911 - DNA, 26 bp, Artificial sequence
  SiRNA target sequence
acaaaaaatttgcaaatattaaaaat

SEQ ID NO: 249912 - DNA, 26 bp, Artificial sequence
  SiRNA target sequence
caaaaaatttgcaaatattaaaaata

SEQ ID NO: 249913 - DNA, 26 bp, Artificial sequence
  SiRNA target sequence
aaaaaatttgcaaatattaaaaatat

SEQ ID NO: 249914 - DNA, 26 bp, Artificial sequence
  SiRNA target sequence
aaaaatttgcaaatattaaaaatata

SEQ ID NO: 249915 - DNA, 26 bp, Artificial sequence
  SiRNA target sequence
aaaatttgcaaatattaaaaatataa

SEQ ID NO: 249916 - DNA, 26 bp, Artificial sequence
  SiRNA target sequence
aaatttgcaaatattaaaaatataaa

SEQ ID NO: 249917 - DNA, 26 bp, Artificial sequence
  SiRNA target sequence
aatttgcaaatattaaaaatataaaa

SEQ ID NO: 249918 - DNA, 26 bp, Artificial sequence
  SiRNA target sequence
atttgcaaatattaaaaatataaaag

SEQ ID NO: 249919 - DNA, 26 bp, Artificial sequence
  SiRNA target sequence
tttgcaaatattaaaaatataaaaga

SEQ ID NO: 249920 - DNA, 26 bp, Artificial sequence
  SiRNA target sequence
ttgcaaatattaaaaatataaaagac

SEQ ID NO: 249921 - DNA, 26 bp, Artificial sequence
  SiRNA target sequence
tgcaaatattaaaaatataaaagaca

SEQ ID NO: 249922 - DNA, 26 bp, Artificial sequence
  SiRNA target sequence
gcaaatattaaaaatataaaagacac

SEQ ID NO: 249923 - DNA, 26 bp, Artificial sequence
  SiRNA target sequence
caaatattaaaaatataaaagacacg

SEQ ID NO: 249924 - DNA, 26 bp, Artificial sequence
  SiRNA target sequence
aaatattaaaaatataaaagacacgt

SEQ ID NO: 249925 - DNA, 26 bp, Artificial sequence
  SiRNA target sequence
aatattaaaaatataaaagacacgta

SEQ ID NO: 249926 - DNA, 26 bp, Artificial sequence
  SiRNA target sequence
atattaaaaatataaaagacacgtat

SEQ ID NO: 249927 - DNA, 26 bp, Artificial sequence
  SiRNA target sequence
tattaaaaatataaaagacacgtatg

SEQ ID NO: 249928 - DNA, 26 bp, Artificial sequence
  SiRNA target sequence
attaaaaatataaaagacacgtatga

SEQ ID NO: 249929 - DNA, 26 bp, Artificial sequence
  SiRNA target sequence
ttaaaaatataaaagacacgtatgat

SEQ ID NO: 249930 - DNA, 26 bp, Artificial sequence
  SiRNA target sequence
taaaaatataaaagacacgtatgata

SEQ ID NO: 249931 - DNA, 26 bp, Artificial sequence
  SiRNA target sequence
aaaaatataaaagacacgtatgatac

SEQ ID NO: 249932 - DNA, 26 bp, Artificial sequence
  SiRNA target sequence
aaaatataaaagacacgtatgatact

SEQ ID NO: 249933 - DNA, 26 bp, Artificial sequence
  SiRNA target sequence
aaatataaaagacacgtatgatactt

SEQ ID NO: 249934 - DNA, 26 bp, Artificial sequence
  SiRNA target sequence
aatataaaagacacgtatgatacttg

SEQ ID NO: 249935 - DNA, 26 bp, Artificial sequence
  SiRNA target sequence
atataaaagacacgtatgatacttgt

SEQ ID NO: 249936 - DNA, 26 bp, Artificial sequence
  SiRNA target sequence
tataaaagacacgtatgatacttgtc

SEQ ID NO: 249937 - DNA, 26 bp, Artificial sequence
  SiRNA target sequence
ataaaagacacgtatgatacttgtct

SEQ ID NO: 249938 - DNA, 26 bp, Artificial sequence
  SiRNA target sequence
taaaagacacgtatgatacttgtcta

SEQ ID NO: 249939 - DNA, 26 bp, Artificial sequence
  SiRNA target sequence
aaaagacacgtatgatacttgtctaa

SEQ ID NO: 249940 - DNA, 26 bp, Artificial sequence
  SiRNA target sequence
aaagacacgtatgatacttgtctaat

SEQ ID NO: 249941 - DNA, 26 bp, Artificial sequence
  SiRNA target sequence
aagacacgtatgatacttgtctaata

SEQ ID NO: 249942 - DNA, 26 bp, Artificial sequence
  SiRNA target sequence
agacacgtatgatacttgtctaatat

SEQ ID NO: 249943 - DNA, 26 bp, Artificial sequence
  SiRNA target sequence
gacacgtatgatacttgtctaatatc

SEQ ID NO: 249944 - DNA, 26 bp, Artificial sequence
  SiRNA target sequence
acacgtatgatacttgtctaatatct

SEQ ID NO: 249945 - DNA, 26 bp, Artificial sequence
  SiRNA target sequence
cacgtatgatacttgtctaatatctg

SEQ ID NO: 249946 - DNA, 26 bp, Artificial sequence
  SiRNA target sequence
acgtatgatacttgtctaatatctgg

SEQ ID NO: 249947 - DNA, 26 bp, Artificial sequence
  SiRNA target sequence
cgtatgatacttgtctaatatctgga

SEQ ID NO: 249948 - DNA, 26 bp, Artificial sequence
  SiRNA target sequence
gtatgatacttgtctaatatctggaa

SEQ ID NO: 249949 - DNA, 26 bp, Artificial sequence
  SiRNA target sequence
tatgatacttgtctaatatctggaat

SEQ ID NO: 249950 - DNA, 26 bp, Artificial sequence
  SiRNA target sequence
atgatacttgtctaatatctggaatt

SEQ ID NO: 249951 - DNA, 26 bp, Artificial sequence
  SiRNA target sequence
tgatacttgtctaatatctggaattt

SEQ ID NO: 249952 - DNA, 26 bp, Artificial sequence
  SiRNA target sequence
gatacttgtctaatatctggaatttc

SEQ ID NO: 249953 - DNA, 26 bp, Artificial sequence
  SiRNA target sequence
atacttgtctaatatctggaatttct

SEQ ID NO: 249954 - DNA, 26 bp, Artificial sequence
  SiRNA target sequence
tacttgtctaatatctggaatttcta

SEQ ID NO: 249955 - DNA, 26 bp, Artificial sequence
  SiRNA target sequence
acttgtctaatatctggaatttctat

SEQ ID NO: 249956 - DNA, 26 bp, Artificial sequence
  SiRNA target sequence
cttgtctaatatctggaatttctata

SEQ ID NO: 249957 - DNA, 26 bp, Artificial sequence
  SiRNA target sequence
ttgtctaatatctggaatttctataa

SEQ ID NO: 249958 - DNA, 26 bp, Artificial sequence
  SiRNA target sequence
tgtctaatatctggaatttctataaa

SEQ ID NO: 249959 - DNA, 26 bp, Artificial sequence
  SiRNA target sequence
gtctaatatctggaatttctataaac

SEQ ID NO: 249960 - DNA, 26 bp, Artificial sequence
  SiRNA target sequence
tctaatatctggaatttctataaacg

SEQ ID NO: 249961 - DNA, 26 bp, Artificial sequence
  SiRNA target sequence
ctaatatctggaatttctataaacgt

SEQ ID NO: 249962 - DNA, 26 bp, Artificial sequence
  SiRNA target sequence
taatatctggaatttctataaacgtc

SEQ ID NO: 249963 - DNA, 26 bp, Artificial sequence
  SiRNA target sequence
aatatctggaatttctataaacgtca

SEQ ID NO: 249964 - DNA, 26 bp, Artificial sequence
  SiRNA target sequence
atatctggaatttctataaacgtcaa

SEQ ID NO: 249965 - DNA, 26 bp, Artificial sequence
  SiRNA target sequence
tatctggaatttctataaacgtcaaa

SEQ ID NO: 249966 - DNA, 26 bp, Artificial sequence
  SiRNA target sequence
atctggaatttctataaacgtcaaaa

SEQ ID NO: 249967 - DNA, 26 bp, Artificial sequence
  SiRNA target sequence
tctggaatttctataaacgtcaaaaa

SEQ ID NO: 249968 - DNA, 26 bp, Artificial sequence
  SiRNA target sequence
ctggaatttctataaacgtcaaaaaa

SEQ ID NO: 249969 - DNA, 26 bp, Artificial sequence
  SiRNA target sequence
tggaatttctataaacgtcaaaaaag

SEQ ID NO: 249970 - DNA, 26 bp, Artificial sequence
  SiRNA target sequence
ggaatttctataaacgtcaaaaaagt

SEQ ID NO: 249971 - DNA, 26 bp, Artificial sequence
  SiRNA target sequence
gaatttctataaacgtcaaaaaagtt

SEQ ID NO: 249972 - DNA, 26 bp, Artificial sequence
  SiRNA target sequence
aatttctataaacgtcaaaaaagttc

SEQ ID NO: 249973 - DNA, 26 bp, Artificial sequence
  SiRNA target sequence
atttctataaacgtcaaaaaagttcc

SEQ ID NO: 249974 - DNA, 26 bp, Artificial sequence
  SiRNA target sequence
tttctataaacgtcaaaaaagttcca

SEQ ID NO: 249975 - DNA, 26 bp, Artificial sequence
  SiRNA target sequence
ttctataaacgtcaaaaaagttccat

SEQ ID NO: 249976 - DNA, 26 bp, Artificial sequence
  SiRNA target sequence
tctataaacgtcaaaaaagttccata

SEQ ID NO: 249977 - DNA, 26 bp, Artificial sequence
  SiRNA target sequence
ctataaacgtcaaaaaagttccatat

SEQ ID NO: 249978 - DNA, 26 bp, Artificial sequence
  SiRNA target sequence
tataaacgtcaaaaaagttccatata

SEQ ID NO: 249979 - DNA, 26 bp, Artificial sequence
  SiRNA target sequence
ataaacgtcaaaaaagttccatataa

SEQ ID NO: 249980 - DNA, 26 bp, Artificial sequence
  SiRNA target sequence
taaacgtcaaaaaagttccatataaa

SEQ ID NO: 249981 - DNA, 26 bp, Artificial sequence
  SiRNA target sequence
aaacgtcaaaaaagttccatataaag

SEQ ID NO: 249982 - DNA, 26 bp, Artificial sequence
  SiRNA target sequence
aacgtcaaaaaagttccatataaaga

SEQ ID NO: 249983 - DNA, 26 bp, Artificial sequence
  SiRNA target sequence
acgtcaaaaaagttccatataaagag

SEQ ID NO: 249984 - DNA, 26 bp, Artificial sequence
  SiRNA target sequence
cgtcaaaaaagttccatataaagaga

SEQ ID NO: 249985 - DNA, 26 bp, Artificial sequence
  SiRNA target sequence
gtcaaaaaagttccatataaagagat

SEQ ID NO: 249986 - DNA, 26 bp, Artificial sequence
  SiRNA target sequence
tcaaaaaagttccatataaagagata

SEQ ID NO: 249987 - DNA, 26 bp, Artificial sequence
  SiRNA target sequence
caaaaaagttccatataaagagataa

SEQ ID NO: 249988 - DNA, 26 bp, Artificial sequence
  SiRNA target sequence
aaaaaagttccatataaagagataat

SEQ ID NO: 249989 - DNA, 26 bp, Artificial sequence
  SiRNA target sequence
aaaaagttccatataaagagataata

SEQ ID NO: 249990 - DNA, 26 bp, Artificial sequence
  SiRNA target sequence
aaaagttccatataaagagataatag

SEQ ID NO: 249991 - DNA, 26 bp, Artificial sequence
  SiRNA target sequence
aaagttccatataaagagataataga

SEQ ID NO: 249992 - DNA, 26 bp, Artificial sequence
  SiRNA target sequence
aagttccatataaagagataatagat

SEQ ID NO: 249993 - DNA, 26 bp, Artificial sequence
  SiRNA target sequence
agttccatataaagagataatagatt

SEQ ID NO: 249994 - DNA, 26 bp, Artificial sequence
  SiRNA target sequence
gttccatataaagagataatagattt

SEQ ID NO: 249995 - DNA, 26 bp, Artificial sequence
  SiRNA target sequence
ttccatataaagagataatagattta

SEQ ID NO: 249996 - DNA, 26 bp, Artificial sequence
  SiRNA target sequence
tccatataaagagataatagatttac

SEQ ID NO: 249997 - DNA, 26 bp, Artificial sequence
  SiRNA target sequence
ccatataaagagataatagatttacc

SEQ ID NO: 249998 - DNA, 26 bp, Artificial sequence
  SiRNA target sequence
catataaagagataatagatttacca

SEQ ID NO: 249999 - DNA, 26 bp, Artificial sequence
  SiRNA target sequence
atataaagagataatagatttaccaa

SEQ ID NO: 250000 - DNA, 26 bp, Artificial sequence
  SiRNA target sequence
tataaagagataatagatttaccaat

SEQ ID NO: 250001 - DNA, 26 bp, Artificial sequence
  SiRNA target sequence
ataaagagataatagatttaccaatt

SEQ ID NO: 250002 - DNA, 26 bp, Artificial sequence
  SiRNA target sequence
taaagagataatagatttaccaattt

SEQ ID NO: 250003 - DNA, 26 bp, Artificial sequence
  SiRNA target sequence
aaagagataatagatttaccaatttt

SEQ ID NO: 250004 - DNA, 26 bp, Artificial sequence
  SiRNA target sequence
aagagataatagatttaccaattttg

SEQ ID NO: 250005 - DNA, 26 bp, Artificial sequence
  SiRNA target sequence
agagataatagatttaccaattttga

SEQ ID NO: 250006 - DNA, 26 bp, Artificial sequence
  SiRNA target sequence
gagataatagatttaccaattttgat

SEQ ID NO: 250007 - DNA, 26 bp, Artificial sequence
  SiRNA target sequence
agataatagatttaccaattttgata

SEQ ID NO: 250008 - DNA, 26 bp, Artificial sequence
  SiRNA target sequence
gataatagatttaccaattttgatac

SEQ ID NO: 250009 - DNA, 26 bp, Artificial sequence
  SiRNA target sequence
ataatagatttaccaattttgataca

SEQ ID NO: 250010 - DNA, 26 bp, Artificial sequence
  SiRNA target sequence
taatagatttaccaattttgatacat

SEQ ID NO: 250011 - DNA, 26 bp, Artificial sequence
  SiRNA target sequence
aatagatttaccaattttgatacata

SEQ ID NO: 250012 - DNA, 26 bp, Artificial sequence
  SiRNA target sequence
atagatttaccaattttgatacatac

SEQ ID NO: 250013 - DNA, 26 bp, Artificial sequence
  SiRNA target sequence
tagatttaccaattttgatacataca

SEQ ID NO: 250014 - DNA, 26 bp, Artificial sequence
  SiRNA target sequence
agatttaccaattttgatacatacac

SEQ ID NO: 250015 - DNA, 26 bp, Artificial sequence
  SiRNA target sequence
gatttaccaattttgatacatacacc

SEQ ID NO: 250016 - DNA, 26 bp, Artificial sequence
  SiRNA target sequence
atttaccaattttgatacatacacca

SEQ ID NO: 250017 - DNA, 26 bp, Artificial sequence
  SiRNA target sequence
tttaccaattttgatacatacaccat

SEQ ID NO: 250018 - DNA, 26 bp, Artificial sequence
  SiRNA target sequence
ttaccaattttgatacatacaccatc

SEQ ID NO: 250019 - DNA, 26 bp, Artificial sequence
  SiRNA target sequence
taccaattttgatacatacaccatca

SEQ ID NO: 250020 - DNA, 26 bp, Artificial sequence
  SiRNA target sequence
accaattttgatacatacaccatcat

SEQ ID NO: 250021 - DNA, 26 bp, Artificial sequence
  SiRNA target sequence
ccaattttgatacatacaccatcata

SEQ ID NO: 250022 - DNA, 26 bp, Artificial sequence
  SiRNA target sequence
caattttgatacatacaccatcataa

SEQ ID NO: 250023 - DNA, 26 bp, Artificial sequence
  SiRNA target sequence
aattttgatacatacaccatcataaa

SEQ ID NO: 250024 - DNA, 26 bp, Artificial sequence
  SiRNA target sequence
attttgatacatacaccatcataaaa

SEQ ID NO: 250025 - DNA, 26 bp, Artificial sequence
  SiRNA target sequence
ttttgatacatacaccatcataaaaa

SEQ ID NO: 250026 - DNA, 26 bp, Artificial sequence
  SiRNA target sequence
tttgatacatacaccatcataaaaac

SEQ ID NO: 250027 - DNA, 26 bp, Artificial sequence
  SiRNA target sequence
ttgatacatacaccatcataaaaact

SEQ ID NO: 250028 - DNA, 26 bp, Artificial sequence
  SiRNA target sequence
tgatacatacaccatcataaaaactt

SEQ ID NO: 250029 - DNA, 26 bp, Artificial sequence
  SiRNA target sequence
gatacatacaccatcataaaaacttt

SEQ ID NO: 250030 - DNA, 26 bp, Artificial sequence
  SiRNA target sequence
atacatacaccatcataaaaactttt

SEQ ID NO: 250031 - DNA, 26 bp, Artificial sequence
  SiRNA target sequence
tacatacaccatcataaaaactttta

SEQ ID NO: 250032 - DNA, 26 bp, Artificial sequence
  SiRNA target sequence
acatacaccatcataaaaacttttaa

SEQ ID NO: 250033 - DNA, 26 bp, Artificial sequence
  SiRNA target sequence
catacaccatcataaaaacttttaaa

SEQ ID NO: 250034 - DNA, 26 bp, Artificial sequence
  SiRNA target sequence
atacaccatcataaaaacttttaaat

SEQ ID NO: 250035 - DNA, 26 bp, Artificial sequence
  SiRNA target sequence
tacaccatcataaaaacttttaaatt

SEQ ID NO: 250036 - DNA, 26 bp, Artificial sequence
  SiRNA target sequence
acaccatcataaaaacttttaaattt

SEQ ID NO: 250037 - DNA, 26 bp, Artificial sequence
  SiRNA target sequence
caccatcataaaaacttttaaattta

SEQ ID NO: 250038 - DNA, 26 bp, Artificial sequence
  SiRNA target sequence
accatcataaaaacttttaaatttat

SEQ ID NO: 250039 - DNA, 26 bp, Artificial sequence
  SiRNA target sequence
ccatcataaaaacttttaaatttata

SEQ ID NO: 250040 - DNA, 26 bp, Artificial sequence
  SiRNA target sequence
catcataaaaacttttaaatttatac

SEQ ID NO: 250041 - DNA, 26 bp, Artificial sequence
  SiRNA target sequence
atcataaaaacttttaaatttatacc

SEQ ID NO: 250042 - DNA, 26 bp, Artificial sequence
  SiRNA target sequence
tcataaaaacttttaaatttatacct

SEQ ID NO: 250043 - DNA, 26 bp, Artificial sequence
  SiRNA target sequence
cataaaaacttttaaatttatacctg

SEQ ID NO: 250044 - DNA, 26 bp, Artificial sequence
  SiRNA target sequence
ataaaaacttttaaatttatacctgt

SEQ ID NO: 250045 - DNA, 26 bp, Artificial sequence
  SiRNA target sequence
taaaaacttttaaatttatacctgta

SEQ ID NO: 250046 - DNA, 26 bp, Artificial sequence
  SiRNA target sequence
aaaaacttttaaatttatacctgtat

SEQ ID NO: 250047 - DNA, 26 bp, Artificial sequence
  SiRNA target sequence
aaaacttttaaatttatacctgtatt

SEQ ID NO: 250048 - DNA, 26 bp, Artificial sequence
  SiRNA target sequence
aaacttttaaatttatacctgtattt

SEQ ID NO: 250049 - DNA, 26 bp, Artificial sequence
  SiRNA target sequence
aacttttaaatttatacctgtattta

SEQ ID NO: 250050 - DNA, 26 bp, Artificial sequence
  SiRNA target sequence
acttttaaatttatacctgtatttaa

SEQ ID NO: 250051 - DNA, 26 bp, Artificial sequence
  SiRNA target sequence
cttttaaatttatacctgtatttaac

SEQ ID NO: 250052 - DNA, 26 bp, Artificial sequence
  SiRNA target sequence
ttttaaatttatacctgtatttaaca

SEQ ID NO: 250053 - DNA, 26 bp, Artificial sequence
  SiRNA target sequence
tttaaatttatacctgtatttaacag

SEQ ID NO: 250054 - DNA, 26 bp, Artificial sequence
  SiRNA target sequence
ttaaatttatacctgtatttaacagg

SEQ ID NO: 250055 - DNA, 26 bp, Artificial sequence
  SiRNA target sequence
taaatttatacctgtatttaacaggc

SEQ ID NO: 250056 - DNA, 26 bp, Artificial sequence
  SiRNA target sequence
aaatttatacctgtatttaacaggca

SEQ ID NO: 250057 - DNA, 26 bp, Artificial sequence
  SiRNA target sequence
aatttatacctgtatttaacaggcac

SEQ ID NO: 250058 - DNA, 26 bp, Artificial sequence
  SiRNA target sequence
atttatacctgtatttaacaggcacc

SEQ ID NO: 250059 - DNA, 26 bp, Artificial sequence
  SiRNA target sequence
tttatacctgtatttaacaggcaccc

SEQ ID NO: 250060 - DNA, 26 bp, Artificial sequence
  SiRNA target sequence
ttatacctgtatttaacaggcaccct

SEQ ID NO: 250061 - DNA, 26 bp, Artificial sequence
  SiRNA target sequence
tatacctgtatttaacaggcaccctc

SEQ ID NO: 250062 - DNA, 26 bp, Artificial sequence
  SiRNA target sequence
atacctgtatttaacaggcaccctca

SEQ ID NO: 250063 - DNA, 26 bp, Artificial sequence
  SiRNA target sequence
tacctgtatttaacaggcaccctcat

SEQ ID NO: 250064 - DNA, 26 bp, Artificial sequence
  SiRNA target sequence
acctgtatttaacaggcaccctcata

SEQ ID NO: 250065 - DNA, 26 bp, Artificial sequence
  SiRNA target sequence
cctgtatttaacaggcaccctcatag

SEQ ID NO: 250066 - DNA, 26 bp, Artificial sequence
  SiRNA target sequence
ctgtatttaacaggcaccctcataga

SEQ ID NO: 250067 - DNA, 26 bp, Artificial sequence
  SiRNA target sequence
tgtatttaacaggcaccctcatagaa

SEQ ID NO: 250068 - DNA, 26 bp, Artificial sequence
  SiRNA target sequence
gtatttaacaggcaccctcatagaaa

SEQ ID NO: 250069 - DNA, 26 bp, Artificial sequence
  SiRNA target sequence
tatttaacaggcaccctcatagaaag

SEQ ID NO: 250070 - DNA, 26 bp, Artificial sequence
  SiRNA target sequence
atttaacaggcaccctcatagaaagc

SEQ ID NO: 250071 - DNA, 26 bp, Artificial sequence
  SiRNA target sequence
tttaacaggcaccctcatagaaagca

SEQ ID NO: 250072 - DNA, 26 bp, Artificial sequence
  SiRNA target sequence
ttaacaggcaccctcatagaaagcat

SEQ ID NO: 250073 - DNA, 26 bp, Artificial sequence
  SiRNA target sequence
taacaggcaccctcatagaaagcatt

SEQ ID NO: 250074 - DNA, 26 bp, Artificial sequence
  SiRNA target sequence
aacaggcaccctcatagaaagcattt

SEQ ID NO: 250075 - DNA, 26 bp, Artificial sequence
  SiRNA target sequence
acaggcaccctcatagaaagcatttc

SEQ ID NO: 250076 - DNA, 26 bp, Artificial sequence
  SiRNA target sequence
caggcaccctcatagaaagcatttct

SEQ ID NO: 250077 - DNA, 26 bp, Artificial sequence
  SiRNA target sequence
aggcaccctcatagaaagcatttctt

SEQ ID NO: 250078 - DNA, 26 bp, Artificial sequence
  SiRNA target sequence
ggcaccctcatagaaagcatttcttt

SEQ ID NO: 250079 - DNA, 26 bp, Artificial sequence
  SiRNA target sequence
gcaccctcatagaaagcatttctttt

SEQ ID NO: 250080 - DNA, 26 bp, Artificial sequence
  SiRNA target sequence
caccctcatagaaagcatttcttttg

SEQ ID NO: 250081 - DNA, 26 bp, Artificial sequence
  SiRNA target sequence
accctcatagaaagcatttcttttgc

SEQ ID NO: 250082 - DNA, 26 bp, Artificial sequence
  SiRNA target sequence
ccctcatagaaagcatttcttttgct

SEQ ID NO: 250083 - DNA, 26 bp, Artificial sequence
  SiRNA target sequence
cctcatagaaagcatttcttttgcta

SEQ ID NO: 250084 - DNA, 26 bp, Artificial sequence
  SiRNA target sequence
ctcatagaaagcatttcttttgctaa

SEQ ID NO: 250085 - DNA, 26 bp, Artificial sequence
  SiRNA target sequence
tcatagaaagcatttcttttgctaaa

SEQ ID NO: 250086 - DNA, 26 bp, Artificial sequence
  SiRNA target sequence
catagaaagcatttcttttgctaaat

SEQ ID NO: 250087 - DNA, 26 bp, Artificial sequence
  SiRNA target sequence
atagaaagcatttcttttgctaaatc

SEQ ID NO: 250088 - DNA, 26 bp, Artificial sequence
  SiRNA target sequence
tagaaagcatttcttttgctaaatca

SEQ ID NO: 250089 - DNA, 26 bp, Artificial sequence
  SiRNA target sequence
agaaagcatttcttttgctaaatcaa

SEQ ID NO: 250090 - DNA, 26 bp, Artificial sequence
  SiRNA target sequence
gaaagcatttcttttgctaaatcaaa

SEQ ID NO: 250091 - DNA, 26 bp, Artificial sequence
  SiRNA target sequence
aaagcatttcttttgctaaatcaaat

SEQ ID NO: 250092 - DNA, 26 bp, Artificial sequence
  SiRNA target sequence
aagcatttcttttgctaaatcaaata

SEQ ID NO: 250093 - DNA, 26 bp, Artificial sequence
  SiRNA target sequence
agcatttcttttgctaaatcaaataa

SEQ ID NO: 250094 - DNA, 26 bp, Artificial sequence
  SiRNA target sequence
gcatttcttttgctaaatcaaataaa

SEQ ID NO: 250095 - DNA, 26 bp, Artificial sequence
  SiRNA target sequence
catttcttttgctaaatcaaataaaa

SEQ ID NO: 250096 - DNA, 26 bp, Artificial sequence
  SiRNA target sequence
atttcttttgctaaatcaaataaaac

SEQ ID NO: 250097 - DNA, 26 bp, Artificial sequence
  SiRNA target sequence
tttcttttgctaaatcaaataaaaca

SEQ ID NO: 250098 - DNA, 26 bp, Artificial sequence
  SiRNA target sequence
ttcttttgctaaatcaaataaaacat

SEQ ID NO: 250099 - DNA, 26 bp, Artificial sequence
  SiRNA target sequence
tcttttgctaaatcaaataaaacata

SEQ ID NO: 250100 - DNA, 26 bp, Artificial sequence
  SiRNA target sequence
cttttgctaaatcaaataaaacatat

SEQ ID NO: 250101 - DNA, 26 bp, Artificial sequence
  SiRNA target sequence
ttttgctaaatcaaataaaacatatt

SEQ ID NO: 250102 - DNA, 26 bp, Artificial sequence
  SiRNA target sequence
tttgctaaatcaaataaaacatattt

SEQ ID NO: 250103 - DNA, 26 bp, Artificial sequence
  SiRNA target sequence
ttgctaaatcaaataaaacatatttg

SEQ ID NO: 250104 - DNA, 26 bp, Artificial sequence
  SiRNA target sequence
tgctaaatcaaataaaacatatttgg

SEQ ID NO: 250105 - DNA, 26 bp, Artificial sequence
  SiRNA target sequence
gctaaatcaaataaaacatatttggt

SEQ ID NO: 250106 - DNA, 26 bp, Artificial sequence
  SiRNA target sequence
ctaaatcaaataaaacatatttggta

SEQ ID NO: 250107 - DNA, 26 bp, Artificial sequence
  SiRNA target sequence
taaatcaaataaaacatatttggtaa

SEQ ID NO: 250108 - DNA, 26 bp, Artificial sequence
  SiRNA target sequence
aaatcaaataaaacatatttggtaat

SEQ ID NO: 250109 - DNA, 26 bp, Artificial sequence
  SiRNA target sequence
aatcaaataaaacatatttggtaatt

SEQ ID NO: 250110 - DNA, 26 bp, Artificial sequence
  SiRNA target sequence
atcaaataaaacatatttggtaattt

SEQ ID NO: 250111 - DNA, 26 bp, Artificial sequence
  SiRNA target sequence
tcaaataaaacatatttggtaatttt

SEQ ID NO: 250112 - DNA, 26 bp, Artificial sequence
  SiRNA target sequence
caaataaaacatatttggtaatttta

SEQ ID NO: 250113 - DNA, 26 bp, Artificial sequence
  SiRNA target sequence
aaataaaacatatttggtaattttag

SEQ ID NO: 250114 - DNA, 26 bp, Artificial sequence
  SiRNA target sequence
aataaaacatatttggtaattttaga

SEQ ID NO: 250115 - DNA, 26 bp, Artificial sequence
  SiRNA target sequence
ataaaacatatttggtaattttagaa

SEQ ID NO: 250116 - DNA, 26 bp, Artificial sequence
  SiRNA target sequence
taaaacatatttggtaattttagaaa

SEQ ID NO: 250117 - DNA, 26 bp, Artificial sequence
  SiRNA target sequence
aaaacatatttggtaattttagaaaa

SEQ ID NO: 250118 - DNA, 26 bp, Artificial sequence
  SiRNA target sequence
aaacatatttggtaattttagaaaat

SEQ ID NO: 250119 - DNA, 26 bp, Artificial sequence
  SiRNA target sequence
aacatatttggtaattttagaaaatg

SEQ ID NO: 250120 - DNA, 26 bp, Artificial sequence
  SiRNA target sequence
acatatttggtaattttagaaaatgc

SEQ ID NO: 250121 - DNA, 26 bp, Artificial sequence
  SiRNA target sequence
catatttggtaattttagaaaatgca

SEQ ID NO: 250122 - DNA, 26 bp, Artificial sequence
  SiRNA target sequence
atatttggtaattttagaaaatgcaa

SEQ ID NO: 250123 - DNA, 26 bp, Artificial sequence
  SiRNA target sequence
tatttggtaattttagaaaatgcaaa

SEQ ID NO: 250124 - DNA, 26 bp, Artificial sequence
  SiRNA target sequence
atttggtaattttagaaaatgcaaat

SEQ ID NO: 250125 - DNA, 26 bp, Artificial sequence
  SiRNA target sequence
tttggtaattttagaaaatgcaaatc

SEQ ID NO: 250126 - DNA, 26 bp, Artificial sequence
  SiRNA target sequence
ttggtaattttagaaaatgcaaatcc

SEQ ID NO: 250127 - DNA, 26 bp, Artificial sequence
  SiRNA target sequence
tggtaattttagaaaatgcaaatcca

SEQ ID NO: 250128 - DNA, 26 bp, Artificial sequence
  SiRNA target sequence
ggtaattttagaaaatgcaaatccaa

SEQ ID NO: 250129 - DNA, 26 bp, Artificial sequence
  SiRNA target sequence
gtaattttagaaaatgcaaatccaat

SEQ ID NO: 250130 - DNA, 26 bp, Artificial sequence
  SiRNA target sequence
taattttagaaaatgcaaatccaatg

SEQ ID NO: 250131 - DNA, 26 bp, Artificial sequence
  SiRNA target sequence
aattttagaaaatgcaaatccaatgg

SEQ ID NO: 250132 - DNA, 26 bp, Artificial sequence
  SiRNA target sequence
attttagaaaatgcaaatccaatggt

SEQ ID NO: 250133 - DNA, 26 bp, Artificial sequence
  SiRNA target sequence
ttttagaaaatgcaaatccaatggtt

SEQ ID NO: 250134 - DNA, 26 bp, Artificial sequence
  SiRNA target sequence
tttagaaaatgcaaatccaatggttg

SEQ ID NO: 250135 - DNA, 26 bp, Artificial sequence
  SiRNA target sequence
ttagaaaatgcaaatccaatggttgc

SEQ ID NO: 250136 - DNA, 26 bp, Artificial sequence
  SiRNA target sequence
tagaaaatgcaaatccaatggttgca

SEQ ID NO: 250137 - DNA, 26 bp, Artificial sequence
  SiRNA target sequence
agaaaatgcaaatccaatggttgcac

SEQ ID NO: 250138 - DNA, 26 bp, Artificial sequence
  SiRNA target sequence
gaaaatgcaaatccaatggttgcaca

SEQ ID NO: 250139 - DNA, 26 bp, Artificial sequence
  SiRNA target sequence
aaaatgcaaatccaatggttgcacac

SEQ ID NO: 250140 - DNA, 26 bp, Artificial sequence
  SiRNA target sequence
aaatgcaaatccaatggttgcacacc

SEQ ID NO: 250141 - DNA, 26 bp, Artificial sequence
  SiRNA target sequence
aatgcaaatccaatggttgcacacca

SEQ ID NO: 250142 - DNA, 26 bp, Artificial sequence
  SiRNA target sequence
atgcaaatccaatggttgcacaccaa

SEQ ID NO: 250143 - DNA, 26 bp, Artificial sequence
  SiRNA target sequence
tgcaaatccaatggttgcacaccaat

SEQ ID NO: 250144 - DNA, 26 bp, Artificial sequence
  SiRNA target sequence
gcaaatccaatggttgcacaccaatt

SEQ ID NO: 250145 - DNA, 26 bp, Artificial sequence
  SiRNA target sequence
caaatccaatggttgcacaccaattt

SEQ ID NO: 250146 - DNA, 26 bp, Artificial sequence
  SiRNA target sequence
aaatccaatggttgcacaccaatttt

SEQ ID NO: 250147 - DNA, 26 bp, Artificial sequence
  SiRNA target sequence
aatccaatggttgcacaccaattttc

SEQ ID NO: 250148 - DNA, 26 bp, Artificial sequence
  SiRNA target sequence
atccaatggttgcacaccaattttca

SEQ ID NO: 250149 - DNA, 26 bp, Artificial sequence
  SiRNA target sequence
tccaatggttgcacaccaattttcaa

SEQ ID NO: 250150 - DNA, 26 bp, Artificial sequence
  SiRNA target sequence
ccaatggttgcacaccaattttcaag

SEQ ID NO: 250151 - DNA, 26 bp, Artificial sequence
  SiRNA target sequence
caatggttgcacaccaattttcaaga

SEQ ID NO: 250152 - DNA, 26 bp, Artificial sequence
  SiRNA target sequence
aatggttgcacaccaattttcaagat

SEQ ID NO: 250153 - DNA, 26 bp, Artificial sequence
  SiRNA target sequence
atggttgcacaccaattttcaagatt

SEQ ID NO: 250154 - DNA, 26 bp, Artificial sequence
  SiRNA target sequence
tggttgcacaccaattttcaagattt

SEQ ID NO: 250155 - DNA, 26 bp, Artificial sequence
  SiRNA target sequence
ggttgcacaccaattttcaagattta

SEQ ID NO: 250156 - DNA, 26 bp, Artificial sequence
  SiRNA target sequence
gttgcacaccaattttcaagatttat

SEQ ID NO: 250157 - DNA, 26 bp, Artificial sequence
  SiRNA target sequence
ttgcacaccaattttcaagatttatt

SEQ ID NO: 250158 - DNA, 26 bp, Artificial sequence
  SiRNA target sequence
tgcacaccaattttcaagatttattc

SEQ ID NO: 250159 - DNA, 26 bp, Artificial sequence
  SiRNA target sequence
gcacaccaattttcaagatttattct

SEQ ID NO: 250160 - DNA, 26 bp, Artificial sequence
  SiRNA target sequence
cacaccaattttcaagatttattctt

SEQ ID NO: 250161 - DNA, 26 bp, Artificial sequence
  SiRNA target sequence
acaccaattttcaagatttattctta

SEQ ID NO: 250162 - DNA, 26 bp, Artificial sequence
  SiRNA target sequence
caccaattttcaagatttattcttaa

SEQ ID NO: 250163 - DNA, 26 bp, Artificial sequence
  SiRNA target sequence
accaattttcaagatttattcttaag

SEQ ID NO: 250164 - DNA, 26 bp, Artificial sequence
  SiRNA target sequence
ccaattttcaagatttattcttaaga

SEQ ID NO: 250165 - DNA, 26 bp, Artificial sequence
  SiRNA target sequence
caattttcaagatttattcttaagac

SEQ ID NO: 250166 - DNA, 26 bp, Artificial sequence
  SiRNA target sequence
aattttcaagatttattcttaagacc

SEQ ID NO: 250167 - DNA, 26 bp, Artificial sequence
  SiRNA target sequence
attttcaagatttattcttaagaccg

SEQ ID NO: 250168 - DNA, 26 bp, Artificial sequence
  SiRNA target sequence
ttttcaagatttattcttaagaccga

SEQ ID NO: 250169 - DNA, 26 bp, Artificial sequence
  SiRNA target sequence
tttcaagatttattcttaagaccgat

SEQ ID NO: 250170 - DNA, 26 bp, Artificial sequence
  SiRNA target sequence
ttcaagatttattcttaagaccgatg

SEQ ID NO: 250171 - DNA, 26 bp, Artificial sequence
  SiRNA target sequence
tcaagatttattcttaagaccgatgg

SEQ ID NO: 250172 - DNA, 26 bp, Artificial sequence
  SiRNA target sequence
caagatttattcttaagaccgatgga

SEQ ID NO: 250173 - DNA, 26 bp, Artificial sequence
  SiRNA target sequence
aagatttattcttaagaccgatggag

SEQ ID NO: 250174 - DNA, 26 bp, Artificial sequence
  SiRNA target sequence
agatttattcttaagaccgatggagc

SEQ ID NO: 250175 - DNA, 26 bp, Artificial sequence
  SiRNA target sequence
gatttattcttaagaccgatggagct

SEQ ID NO: 250176 - DNA, 26 bp, Artificial sequence
  SiRNA target sequence
atttattcttaagaccgatggagctg

SEQ ID NO: 250177 - DNA, 26 bp, Artificial sequence
  SiRNA target sequence
tttattcttaagaccgatggagctgt

SEQ ID NO: 250178 - DNA, 26 bp, Artificial sequence
  SiRNA target sequence
ttattcttaagaccgatggagctgtg

SEQ ID NO: 250179 - DNA, 26 bp, Artificial sequence
  SiRNA target sequence
tattcttaagaccgatggagctgtgc

SEQ ID NO: 250180 - DNA, 26 bp, Artificial sequence
  SiRNA target sequence
attcttaagaccgatggagctgtgcg

SEQ ID NO: 250181 - DNA, 26 bp, Artificial sequence
  SiRNA target sequence
ttcttaagaccgatggagctgtgcgc

SEQ ID NO: 250182 - DNA, 26 bp, Artificial sequence
  SiRNA target sequence
tcttaagaccgatggagctgtgcgca

SEQ ID NO: 250183 - DNA, 26 bp, Artificial sequence
  SiRNA target sequence
cttaagaccgatggagctgtgcgcaa

SEQ ID NO: 250184 - DNA, 26 bp, Artificial sequence
  SiRNA target sequence
ttaagaccgatggagctgtgcgcaaa

SEQ ID NO: 250185 - DNA, 26 bp, Artificial sequence
  SiRNA target sequence
taagaccgatggagctgtgcgcaaat

SEQ ID NO: 250186 - DNA, 26 bp, Artificial sequence
  SiRNA target sequence
aagaccgatggagctgtgcgcaaatt

SEQ ID NO: 250187 - DNA, 26 bp, Artificial sequence
  SiRNA target sequence
agaccgatggagctgtgcgcaaattg

SEQ ID NO: 250188 - DNA, 26 bp, Artificial sequence
  SiRNA target sequence
gaccgatggagctgtgcgcaaattgt

SEQ ID NO: 250189 - DNA, 26 bp, Artificial sequence
  SiRNA target sequence
accgatggagctgtgcgcaaattgta

SEQ ID NO: 250190 - DNA, 26 bp, Artificial sequence
  SiRNA target sequence
ccgatggagctgtgcgcaaattgtaa

SEQ ID NO: 250191 - DNA, 26 bp, Artificial sequence
  SiRNA target sequence
cgatggagctgtgcgcaaattgtaaa

SEQ ID NO: 250192 - DNA, 26 bp, Artificial sequence
  SiRNA target sequence
gatggagctgtgcgcaaattgtaaaa

SEQ ID NO: 250193 - DNA, 26 bp, Artificial sequence
  SiRNA target sequence
atggagctgtgcgcaaattgtaaaaa

SEQ ID NO: 250194 - DNA, 26 bp, Artificial sequence
  SiRNA target sequence
tggagctgtgcgcaaattgtaaaaag

SEQ ID NO: 250195 - DNA, 26 bp, Artificial sequence
  SiRNA target sequence
ggagctgtgcgcaaattgtaaaaaga

SEQ ID NO: 250196 - DNA, 26 bp, Artificial sequence
  SiRNA target sequence
gagctgtgcgcaaattgtaaaaagaa

SEQ ID NO: 250197 - DNA, 26 bp, Artificial sequence
  SiRNA target sequence
agctgtgcgcaaattgtaaaaagaaa

SEQ ID NO: 250198 - DNA, 26 bp, Artificial sequence
  SiRNA target sequence
gctgtgcgcaaattgtaaaaagaaag

SEQ ID NO: 250199 - DNA, 26 bp, Artificial sequence
  SiRNA target sequence
ctgtgcgcaaattgtaaaaagaaagt

SEQ ID NO: 250200 - DNA, 26 bp, Artificial sequence
  SiRNA target sequence
tgtgcgcaaattgtaaaaagaaagtc

SEQ ID NO: 250201 - DNA, 26 bp, Artificial sequence
  SiRNA target sequence
gtgcgcaaattgtaaaaagaaagtcc

SEQ ID NO: 250202 - DNA, 26 bp, Artificial sequence
  SiRNA target sequence
tgcgcaaattgtaaaaagaaagtcct

SEQ ID NO: 250203 - DNA, 26 bp, Artificial sequence
  SiRNA target sequence
gcgcaaattgtaaaaagaaagtcctg

SEQ ID NO: 250204 - DNA, 26 bp, Artificial sequence
  SiRNA target sequence
cgcaaattgtaaaaagaaagtcctga

SEQ ID NO: 250205 - DNA, 26 bp, Artificial sequence
  SiRNA target sequence
gcaaattgtaaaaagaaagtcctgaa

SEQ ID NO: 250206 - DNA, 26 bp, Artificial sequence
  SiRNA target sequence
caaattgtaaaaagaaagtcctgaaa

SEQ ID NO: 250207 - DNA, 26 bp, Artificial sequence
  SiRNA target sequence
aaattgtaaaaagaaagtcctgaaat

SEQ ID NO: 250208 - DNA, 26 bp, Artificial sequence
  SiRNA target sequence
aattgtaaaaagaaagtcctgaaatt

SEQ ID NO: 250209 - DNA, 26 bp, Artificial sequence
  SiRNA target sequence
attgtaaaaagaaagtcctgaaatta

SEQ ID NO: 250210 - DNA, 26 bp, Artificial sequence
  SiRNA target sequence
ttgtaaaaagaaagtcctgaaattag

SEQ ID NO: 250211 - DNA, 26 bp, Artificial sequence
  SiRNA target sequence
tgtaaaaagaaagtcctgaaattaga

SEQ ID NO: 250212 - DNA, 26 bp, Artificial sequence
  SiRNA target sequence
gtaaaaagaaagtcctgaaattagag

SEQ ID NO: 250213 - DNA, 26 bp, Artificial sequence
  SiRNA target sequence
taaaaagaaagtcctgaaattagagc

SEQ ID NO: 250214 - DNA, 26 bp, Artificial sequence
  SiRNA target sequence
aaaaagaaagtcctgaaattagagcg

SEQ ID NO: 250215 - DNA, 26 bp, Artificial sequence
  SiRNA target sequence
aaaagaaagtcctgaaattagagcgg

SEQ ID NO: 250216 - DNA, 26 bp, Artificial sequence
  SiRNA target sequence
aaagaaagtcctgaaattagagcggt

SEQ ID NO: 250217 - DNA, 26 bp, Artificial sequence
  SiRNA target sequence
aagaaagtcctgaaattagagcggta

SEQ ID NO: 250218 - DNA, 26 bp, Artificial sequence
  SiRNA target sequence
agaaagtcctgaaattagagcggtaa

SEQ ID NO: 250219 - DNA, 26 bp, Artificial sequence
  SiRNA target sequence
gaaagtcctgaaattagagcggtaaa

SEQ ID NO: 250220 - DNA, 26 bp, Artificial sequence
  SiRNA target sequence
aaagtcctgaaattagagcggtaaaa

SEQ ID NO: 250221 - DNA, 26 bp, Artificial sequence
  SiRNA target sequence
aagtcctgaaattagagcggtaaaaa

SEQ ID NO: 250222 - DNA, 26 bp, Artificial sequence
  SiRNA target sequence
agtcctgaaattagagcggtaaaaaa

SEQ ID NO: 250223 - DNA, 26 bp, Artificial sequence
  SiRNA target sequence
gtcctgaaattagagcggtaaaaaat

SEQ ID NO: 250224 - DNA, 26 bp, Artificial sequence
  SiRNA target sequence
tcctgaaattagagcggtaaaaaata

SEQ ID NO: 250225 - DNA, 26 bp, Artificial sequence
  SiRNA target sequence
cctgaaattagagcggtaaaaaatat

SEQ ID NO: 250226 - DNA, 26 bp, Artificial sequence
  SiRNA target sequence
ctgaaattagagcggtaaaaaatata

SEQ ID NO: 250227 - DNA, 26 bp, Artificial sequence
  SiRNA target sequence
tgaaattagagcggtaaaaaatatag

SEQ ID NO: 250228 - DNA, 26 bp, Artificial sequence
  SiRNA target sequence
gaaattagagcggtaaaaaatatagc

SEQ ID NO: 250229 - DNA, 26 bp, Artificial sequence
  SiRNA target sequence
aaattagagcggtaaaaaatatagca

SEQ ID NO: 250230 - DNA, 26 bp, Artificial sequence
  SiRNA target sequence
aattagagcggtaaaaaatatagcag

SEQ ID NO: 250231 - DNA, 26 bp, Artificial sequence
  SiRNA target sequence
attagagcggtaaaaaatatagcagc

SEQ ID NO: 250232 - DNA, 26 bp, Artificial sequence
  SiRNA target sequence
ttagagcggtaaaaaatatagcagca

SEQ ID NO: 250233 - DNA, 26 bp, Artificial sequence
  SiRNA target sequence
tagagcggtaaaaaatatagcagcaa

SEQ ID NO: 250234 - DNA, 26 bp, Artificial sequence
  SiRNA target sequence
agagcggtaaaaaatatagcagcaat

SEQ ID NO: 250235 - DNA, 26 bp, Artificial sequence
  SiRNA target sequence
gagcggtaaaaaatatagcagcaata

SEQ ID NO: 250236 - DNA, 26 bp, Artificial sequence
  SiRNA target sequence
agcggtaaaaaatatagcagcaatag

SEQ ID NO: 250237 - DNA, 26 bp, Artificial sequence
  SiRNA target sequence
gcggtaaaaaatatagcagcaatagg

SEQ ID NO: 250238 - DNA, 26 bp, Artificial sequence
  SiRNA target sequence
cggtaaaaaatatagcagcaataggg

SEQ ID NO: 250239 - DNA, 26 bp, Artificial sequence
  SiRNA target sequence
ggtaaaaaatatagcagcaatagggg

SEQ ID NO: 250240 - DNA, 26 bp, Artificial sequence
  SiRNA target sequence
gtaaaaaatatagcagcaatagggga

SEQ ID NO: 250241 - DNA, 26 bp, Artificial sequence
  SiRNA target sequence
taaaaaatatagcagcaataggggag

SEQ ID NO: 250242 - DNA, 26 bp, Artificial sequence
  SiRNA target sequence
aaaaaatatagcagcaataggggagg

SEQ ID NO: 250243 - DNA, 26 bp, Artificial sequence
  SiRNA target sequence
aaaaatatagcagcaataggggaggc

SEQ ID NO: 250244 - DNA, 26 bp, Artificial sequence
  SiRNA target sequence
aaaatatagcagcaataggggaggca

SEQ ID NO: 250245 - DNA, 26 bp, Artificial sequence
  SiRNA target sequence
aaatatagcagcaataggggaggcaa

SEQ ID NO: 250246 - DNA, 26 bp, Artificial sequence
  SiRNA target sequence
aatatagcagcaataggggaggcaat

SEQ ID NO: 250247 - DNA, 26 bp, Artificial sequence
  SiRNA target sequence
atatagcagcaataggggaggcaata

SEQ ID NO: 250248 - DNA, 26 bp, Artificial sequence
  SiRNA target sequence
tatagcagcaataggggaggcaatag

SEQ ID NO: 250249 - DNA, 26 bp, Artificial sequence
  SiRNA target sequence
atagcagcaataggggaggcaataga

SEQ ID NO: 250250 - DNA, 26 bp, Artificial sequence
  SiRNA target sequence
tagcagcaataggggaggcaatagat

SEQ ID NO: 250251 - DNA, 26 bp, Artificial sequence
  SiRNA target sequence
agcagcaataggggaggcaatagata

SEQ ID NO: 250252 - DNA, 26 bp, Artificial sequence
  SiRNA target sequence
gcagcaataggggaggcaatagatag

SEQ ID NO: 250253 - DNA, 26 bp, Artificial sequence
  SiRNA target sequence
cagcaataggggaggcaatagataga

SEQ ID NO: 250254 - DNA, 26 bp, Artificial sequence
  SiRNA target sequence
agcaataggggaggcaatagatagat

SEQ ID NO: 250255 - DNA, 26 bp, Artificial sequence
  SiRNA target sequence
gcaataggggaggcaatagatagata

SEQ ID NO: 250256 - DNA, 26 bp, Artificial sequence
  SiRNA target sequence
caataggggaggcaatagatagataa

SEQ ID NO: 250257 - DNA, 26 bp, Artificial sequence
  SiRNA target sequence
aataggggaggcaatagatagataaa

SEQ ID NO: 250258 - DNA, 26 bp, Artificial sequence
  SiRNA target sequence
ataggggaggcaatagatagataaaa

SEQ ID NO: 250259 - DNA, 26 bp, Artificial sequence
  SiRNA target sequence
taggggaggcaatagatagataaaag

SEQ ID NO: 250260 - DNA, 26 bp, Artificial sequence
  SiRNA target sequence
aggggaggcaatagatagataaaaga

SEQ ID NO: 250261 - DNA, 26 bp, Artificial sequence
  SiRNA target sequence
ggggaggcaatagatagataaaagat

SEQ ID NO: 250262 - DNA, 26 bp, Artificial sequence
  SiRNA target sequence
gggaggcaatagatagataaaagatc

SEQ ID NO: 250263 - DNA, 26 bp, Artificial sequence
  SiRNA target sequence
ggaggcaatagatagataaaagatcc

SEQ ID NO: 250264 - DNA, 26 bp, Artificial sequence
  SiRNA target sequence
gaggcaatagatagataaaagatcct

SEQ ID NO: 250265 - DNA, 26 bp, Artificial sequence
  SiRNA target sequence
aggcaatagatagataaaagatcctt

SEQ ID NO: 250266 - DNA, 26 bp, Artificial sequence
  SiRNA target sequence
ggcaatagatagataaaagatccttg

SEQ ID NO: 250267 - DNA, 26 bp, Artificial sequence
  SiRNA target sequence
gcaatagatagataaaagatccttga

SEQ ID NO: 250268 - DNA, 26 bp, Artificial sequence
  SiRNA target sequence
caatagatagataaaagatccttgat

SEQ ID NO: 250269 - DNA, 26 bp, Artificial sequence
  SiRNA target sequence
aatagatagataaaagatccttgatg

SEQ ID NO: 250270 - DNA, 26 bp, Artificial sequence
  SiRNA target sequence
atagatagataaaagatccttgatgc

SEQ ID NO: 250271 - DNA, 26 bp, Artificial sequence
  SiRNA target sequence
tagatagataaaagatccttgatgca

SEQ ID NO: 250272 - DNA, 26 bp, Artificial sequence
  SiRNA target sequence
agatagataaaagatccttgatgcaa

SEQ ID NO: 250273 - DNA, 26 bp, Artificial sequence
  SiRNA target sequence
gatagataaaagatccttgatgcaat

SEQ ID NO: 250274 - DNA, 26 bp, Artificial sequence
  SiRNA target sequence
atagataaaagatccttgatgcaatg

SEQ ID NO: 250275 - DNA, 26 bp, Artificial sequence
  SiRNA target sequence
tagataaaagatccttgatgcaatgc

SEQ ID NO: 250276 - DNA, 26 bp, Artificial sequence
  SiRNA target sequence
agataaaagatccttgatgcaatgcg

SEQ ID NO: 250277 - DNA, 26 bp, Artificial sequence
  SiRNA target sequence
gataaaagatccttgatgcaatgcga

SEQ ID NO: 250278 - DNA, 26 bp, Artificial sequence
  SiRNA target sequence
ataaaagatccttgatgcaatgcgat

SEQ ID NO: 250279 - DNA, 26 bp, Artificial sequence
  SiRNA target sequence
taaaagatccttgatgcaatgcgatt

SEQ ID NO: 250280 - DNA, 26 bp, Artificial sequence
  SiRNA target sequence
aaaagatccttgatgcaatgcgattt

SEQ ID NO: 250281 - DNA, 26 bp, Artificial sequence
  SiRNA target sequence
aaagatccttgatgcaatgcgatttc

SEQ ID NO: 250282 - DNA, 26 bp, Artificial sequence
  SiRNA target sequence
aagatccttgatgcaatgcgatttcc

SEQ ID NO: 250283 - DNA, 26 bp, Artificial sequence
  SiRNA target sequence
agatccttgatgcaatgcgatttcca

SEQ ID NO: 250284 - DNA, 26 bp, Artificial sequence
  SiRNA target sequence
gatccttgatgcaatgcgatttccac

SEQ ID NO: 250285 - DNA, 26 bp, Artificial sequence
  SiRNA target sequence
atccttgatgcaatgcgatttccacg

SEQ ID NO: 250286 - DNA, 26 bp, Artificial sequence
  SiRNA target sequence
tccttgatgcaatgcgatttccacgg

SEQ ID NO: 250287 - DNA, 26 bp, Artificial sequence
  SiRNA target sequence
ccttgatgcaatgcgatttccacgga

SEQ ID NO: 250288 - DNA, 26 bp, Artificial sequence
  SiRNA target sequence
cttgatgcaatgcgatttccacggat

SEQ ID NO: 250289 - DNA, 26 bp, Artificial sequence
  SiRNA target sequence
ttgatgcaatgcgatttccacggatt

SEQ ID NO: 250290 - DNA, 26 bp, Artificial sequence
  SiRNA target sequence
tgatgcaatgcgatttccacggatta

SEQ ID NO: 250291 - DNA, 26 bp, Artificial sequence
  SiRNA target sequence
gatgcaatgcgatttccacggattac

SEQ ID NO: 250292 - DNA, 26 bp, Artificial sequence
  SiRNA target sequence
atgcaatgcgatttccacggattaca

SEQ ID NO: 250293 - DNA, 26 bp, Artificial sequence
  SiRNA target sequence
tgcaatgcgatttccacggattacaa

SEQ ID NO: 250294 - DNA, 26 bp, Artificial sequence
  SiRNA target sequence
gcaatgcgatttccacggattacaaa

SEQ ID NO: 250295 - DNA, 26 bp, Artificial sequence
  SiRNA target sequence
caatgcgatttccacggattacaaag

SEQ ID NO: 250296 - DNA, 26 bp, Artificial sequence
  SiRNA target sequence
aatgcgatttccacggattacaaagt

SEQ ID NO: 250297 - DNA, 26 bp, Artificial sequence
  SiRNA target sequence
atgcgatttccacggattacaaagtt

SEQ ID NO: 250298 - DNA, 26 bp, Artificial sequence
  SiRNA target sequence
tgcgatttccacggattacaaagtta

SEQ ID NO: 250299 - DNA, 26 bp, Artificial sequence
  SiRNA target sequence
gcgatttccacggattacaaagttat

SEQ ID NO: 250300 - DNA, 26 bp, Artificial sequence
  SiRNA target sequence
cgatttccacggattacaaagttata

SEQ ID NO: 250301 - DNA, 26 bp, Artificial sequence
  SiRNA target sequence
gatttccacggattacaaagttataa

SEQ ID NO: 250302 - DNA, 26 bp, Artificial sequence
  SiRNA target sequence
atttccacggattacaaagttataaa

SEQ ID NO: 250303 - DNA, 26 bp, Artificial sequence
  SiRNA target sequence
tttccacggattacaaagttataaaa

SEQ ID NO: 250304 - DNA, 26 bp, Artificial sequence
  SiRNA target sequence
ttccacggattacaaagttataaaat

SEQ ID NO: 250305 - DNA, 26 bp, Artificial sequence
  SiRNA target sequence
tccacggattacaaagttataaaata

SEQ ID NO: 250306 - DNA, 26 bp, Artificial sequence
  SiRNA target sequence
ccacggattacaaagttataaaataa

SEQ ID NO: 250307 - DNA, 26 bp, Artificial sequence
  SiRNA target sequence
cacggattacaaagttataaaataat

SEQ ID NO: 250308 - DNA, 26 bp, Artificial sequence
  SiRNA target sequence
acggattacaaagttataaaataatg

SEQ ID NO: 250309 - DNA, 26 bp, Artificial sequence
  SiRNA target sequence
cggattacaaagttataaaataatga

SEQ ID NO: 250310 - DNA, 26 bp, Artificial sequence
  SiRNA target sequence
ggattacaaagttataaaataatgat

SEQ ID NO: 250311 - DNA, 26 bp, Artificial sequence
  SiRNA target sequence
gattacaaagttataaaataatgata

SEQ ID NO: 250312 - DNA, 26 bp, Artificial sequence
  SiRNA target sequence
attacaaagttataaaataatgatac

SEQ ID NO: 250313 - DNA, 26 bp, Artificial sequence
  SiRNA target sequence
ttacaaagttataaaataatgataca

SEQ ID NO: 250314 - DNA, 26 bp, Artificial sequence
  SiRNA target sequence
tacaaagttataaaataatgatacag

SEQ ID NO: 250315 - DNA, 26 bp, Artificial sequence
  SiRNA target sequence
acaaagttataaaataatgatacagc

SEQ ID NO: 250316 - DNA, 26 bp, Artificial sequence
  SiRNA target sequence
caaagttataaaataatgatacagca

SEQ ID NO: 250317 - DNA, 26 bp, Artificial sequence
  SiRNA target sequence
aaagttataaaataatgatacagcac

SEQ ID NO: 250318 - DNA, 26 bp, Artificial sequence
  SiRNA target sequence
aagttataaaataatgatacagcact

SEQ ID NO: 250319 - DNA, 26 bp, Artificial sequence
  SiRNA target sequence
agttataaaataatgatacagcacta

SEQ ID NO: 250320 - DNA, 26 bp, Artificial sequence
  SiRNA target sequence
gttataaaataatgatacagcactaa

SEQ ID NO: 250321 - DNA, 26 bp, Artificial sequence
  SiRNA target sequence
ttataaaataatgatacagcactaat

SEQ ID NO: 250322 - DNA, 26 bp, Artificial sequence
  SiRNA target sequence
tataaaataatgatacagcactaatc

SEQ ID NO: 250323 - DNA, 26 bp, Artificial sequence
  SiRNA target sequence
ataaaataatgatacagcactaatcg

SEQ ID NO: 250324 - DNA, 26 bp, Artificial sequence
  SiRNA target sequence
taaaataatgatacagcactaatcgt

SEQ ID NO: 250325 - DNA, 26 bp, Artificial sequence
  SiRNA target sequence
aaaataatgatacagcactaatcgtt

SEQ ID NO: 250326 - DNA, 26 bp, Artificial sequence
  SiRNA target sequence
aaataatgatacagcactaatcgtta

SEQ ID NO: 250327 - DNA, 26 bp, Artificial sequence
  SiRNA target sequence
aataatgatacagcactaatcgttaa

SEQ ID NO: 250328 - DNA, 26 bp, Artificial sequence
  SiRNA target sequence
ataatgatacagcactaatcgttaag

SEQ ID NO: 250329 - DNA, 26 bp, Artificial sequence
  SiRNA target sequence
taatgatacagcactaatcgttaagg

SEQ ID NO: 250330 - DNA, 26 bp, Artificial sequence
  SiRNA target sequence
aatgatacagcactaatcgttaagga

SEQ ID NO: 250331 - DNA, 26 bp, Artificial sequence
  SiRNA target sequence
atgatacagcactaatcgttaaggaa

SEQ ID NO: 250332 - DNA, 26 bp, Artificial sequence
  SiRNA target sequence
tgatacagcactaatcgttaaggaag

SEQ ID NO: 250333 - DNA, 26 bp, Artificial sequence
  SiRNA target sequence
gatacagcactaatcgttaaggaagt

SEQ ID NO: 250334 - DNA, 26 bp, Artificial sequence
  SiRNA target sequence
atacagcactaatcgttaaggaagtt

SEQ ID NO: 250335 - DNA, 26 bp, Artificial sequence
  SiRNA target sequence
tacagcactaatcgttaaggaagttg

SEQ ID NO: 250336 - DNA, 26 bp, Artificial sequence
  SiRNA target sequence
acagcactaatcgttaaggaagttgt

SEQ ID NO: 250337 - DNA, 26 bp, Artificial sequence
  SiRNA target sequence
cagcactaatcgttaaggaagttgtt

SEQ ID NO: 250338 - DNA, 26 bp, Artificial sequence
  SiRNA target sequence
agcactaatcgttaaggaagttgtta

SEQ ID NO: 250339 - DNA, 26 bp, Artificial sequence
  SiRNA target sequence
gcactaatcgttaaggaagttgttac

SEQ ID NO: 250340 - DNA, 26 bp, Artificial sequence
  SiRNA target sequence
cactaatcgttaaggaagttgttact

SEQ ID NO: 250341 - DNA, 26 bp, Artificial sequence
  SiRNA target sequence
actaatcgttaaggaagttgttacta

SEQ ID NO: 250342 - DNA, 26 bp, Artificial sequence
  SiRNA target sequence
ctaatcgttaaggaagttgttactaa

SEQ ID NO: 250343 - DNA, 26 bp, Artificial sequence
  SiRNA target sequence
taatcgttaaggaagttgttactaaa

SEQ ID NO: 250344 - DNA, 26 bp, Artificial sequence
  SiRNA target sequence
aatcgttaaggaagttgttactaaat

SEQ ID NO: 250345 - DNA, 26 bp, Artificial sequence
  SiRNA target sequence
atcgttaaggaagttgttactaaata

SEQ ID NO: 250346 - DNA, 26 bp, Artificial sequence
  SiRNA target sequence
tcgttaaggaagttgttactaaatat

SEQ ID NO: 250347 - DNA, 26 bp, Artificial sequence
  SiRNA target sequence
cgttaaggaagttgttactaaatatt

SEQ ID NO: 250348 - DNA, 26 bp, Artificial sequence
  SiRNA target sequence
gttaaggaagttgttactaaatattt

SEQ ID NO: 250349 - DNA, 26 bp, Artificial sequence
  SiRNA target sequence
ttaaggaagttgttactaaatatttt

SEQ ID NO: 250350 - DNA, 26 bp, Artificial sequence
  SiRNA target sequence
taaggaagttgttactaaatattttt

SEQ ID NO: 250351 - DNA, 26 bp, Artificial sequence
  SiRNA target sequence
aaggaagttgttactaaatatttttg

SEQ ID NO: 250352 - DNA, 26 bp, Artificial sequence
  SiRNA target sequence
aggaagttgttactaaatatttttga

SEQ ID NO: 250353 - DNA, 26 bp, Artificial sequence
  SiRNA target sequence
ggaagttgttactaaatatttttgag

SEQ ID NO: 250354 - DNA, 26 bp, Artificial sequence
  SiRNA target sequence
gaagttgttactaaatatttttgaga

SEQ ID NO: 250355 - DNA, 26 bp, Artificial sequence
  SiRNA target sequence
aagttgttactaaatatttttgagaa

SEQ ID NO: 250356 - DNA, 26 bp, Artificial sequence
  SiRNA target sequence
agttgttactaaatatttttgagaat

SEQ ID NO: 250357 - DNA, 26 bp, Artificial sequence
  SiRNA target sequence
gttgttactaaatatttttgagaata

SEQ ID NO: 250358 - DNA, 26 bp, Artificial sequence
  SiRNA target sequence
ttgttactaaatatttttgagaataa

SEQ ID NO: 250359 - DNA, 26 bp, Artificial sequence
  SiRNA target sequence
tgttactaaatatttttgagaataat

SEQ ID NO: 250360 - DNA, 26 bp, Artificial sequence
  SiRNA target sequence
gttactaaatatttttgagaataatc

SEQ ID NO: 250361 - DNA, 26 bp, Artificial sequence
  SiRNA target sequence
ttactaaatatttttgagaataatct

SEQ ID NO: 250362 - DNA, 26 bp, Artificial sequence
  SiRNA target sequence
tactaaatatttttgagaataatctt

SEQ ID NO: 250363 - DNA, 26 bp, Artificial sequence
  SiRNA target sequence
actaaatatttttgagaataatcttt

SEQ ID NO: 250364 - DNA, 26 bp, Artificial sequence
  SiRNA target sequence
ctaaatatttttgagaataatctttc

SEQ ID NO: 250365 - DNA, 26 bp, Artificial sequence
  SiRNA target sequence
taaatatttttgagaataatctttcg

SEQ ID NO: 250366 - DNA, 26 bp, Artificial sequence
  SiRNA target sequence
aaatatttttgagaataatctttcgg

SEQ ID NO: 250367 - DNA, 26 bp, Artificial sequence
  SiRNA target sequence
aatatttttgagaataatctttcgga

SEQ ID NO: 250368 - DNA, 26 bp, Artificial sequence
  SiRNA target sequence
atatttttgagaataatctttcggag

SEQ ID NO: 250369 - DNA, 26 bp, Artificial sequence
  SiRNA target sequence
tatttttgagaataatctttcggagg

SEQ ID NO: 250370 - DNA, 26 bp, Artificial sequence
  SiRNA target sequence
atttttgagaataatctttcggaggc

SEQ ID NO: 250371 - DNA, 26 bp, Artificial sequence
  SiRNA target sequence
tttttgagaataatctttcggaggca

SEQ ID NO: 250372 - DNA, 26 bp, Artificial sequence
  SiRNA target sequence
ttttgagaataatctttcggaggcat

SEQ ID NO: 250373 - DNA, 26 bp, Artificial sequence
  SiRNA target sequence
tttgagaataatctttcggaggcata

SEQ ID NO: 250374 - DNA, 26 bp, Artificial sequence
  SiRNA target sequence
ttgagaataatctttcggaggcatat

SEQ ID NO: 250375 - DNA, 26 bp, Artificial sequence
  SiRNA target sequence
tgagaataatctttcggaggcatatt

SEQ ID NO: 250376 - DNA, 26 bp, Artificial sequence
  SiRNA target sequence
gagaataatctttcggaggcatatta

SEQ ID NO: 250377 - DNA, 26 bp, Artificial sequence
  SiRNA target sequence
agaataatctttcggaggcatattat

SEQ ID NO: 250378 - DNA, 26 bp, Artificial sequence
  SiRNA target sequence
gaataatctttcggaggcatattatt

SEQ ID NO: 250379 - DNA, 26 bp, Artificial sequence
  SiRNA target sequence
aataatctttcggaggcatattatta

SEQ ID NO: 250380 - DNA, 26 bp, Artificial sequence
  SiRNA target sequence
ataatctttcggaggcatattattaa

SEQ ID NO: 250381 - DNA, 26 bp, Artificial sequence
  SiRNA target sequence
taatctttcggaggcatattattaat

SEQ ID NO: 250382 - DNA, 26 bp, Artificial sequence
  SiRNA target sequence
aatctttcggaggcatattattaatt

SEQ ID NO: 250383 - DNA, 26 bp, Artificial sequence
  SiRNA target sequence
atctttcggaggcatattattaattc

SEQ ID NO: 250384 - DNA, 26 bp, Artificial sequence
  SiRNA target sequence
tctttcggaggcatattattaattct

SEQ ID NO: 250385 - DNA, 26 bp, Artificial sequence
  SiRNA target sequence
ctttcggaggcatattattaattctg

SEQ ID NO: 250386 - DNA, 26 bp, Artificial sequence
  SiRNA target sequence
tttcggaggcatattattaattctgc

SEQ ID NO: 250387 - DNA, 26 bp, Artificial sequence
  SiRNA target sequence
ttcggaggcatattattaattctgct

SEQ ID NO: 250388 - DNA, 26 bp, Artificial sequence
  SiRNA target sequence
tcggaggcatattattaattctgctt

SEQ ID NO: 250389 - DNA, 26 bp, Artificial sequence
  SiRNA target sequence
cggaggcatattattaattctgcttc

SEQ ID NO: 250390 - DNA, 26 bp, Artificial sequence
  SiRNA target sequence
ggaggcatattattaattctgcttcc

SEQ ID NO: 250391 - DNA, 26 bp, Artificial sequence
  SiRNA target sequence
gaggcatattattaattctgcttccc

SEQ ID NO: 250392 - DNA, 26 bp, Artificial sequence
  SiRNA target sequence
aggcatattattaattctgcttcccg

SEQ ID NO: 250393 - DNA, 26 bp, Artificial sequence
  SiRNA target sequence
ggcatattattaattctgcttcccgt

SEQ ID NO: 250394 - DNA, 26 bp, Artificial sequence
  SiRNA target sequence
gcatattattaattctgcttcccgta

SEQ ID NO: 250395 - DNA, 26 bp, Artificial sequence
  SiRNA target sequence
catattattaattctgcttcccgtag

SEQ ID NO: 250396 - DNA, 26 bp, Artificial sequence
  SiRNA target sequence
atattattaattctgcttcccgtaga

SEQ ID NO: 250397 - DNA, 26 bp, Artificial sequence
  SiRNA target sequence
tattattaattctgcttcccgtagat

SEQ ID NO: 250398 - DNA, 26 bp, Artificial sequence
  SiRNA target sequence
attattaattctgcttcccgtagata

SEQ ID NO: 250399 - DNA, 26 bp, Artificial sequence
  SiRNA target sequence
ttattaattctgcttcccgtagataa

SEQ ID NO: 250400 - DNA, 26 bp, Artificial sequence
  SiRNA target sequence
tattaattctgcttcccgtagataaa

SEQ ID NO: 250401 - DNA, 26 bp, Artificial sequence
  SiRNA target sequence
attaattctgcttcccgtagataaag

SEQ ID NO: 250402 - DNA, 26 bp, Artificial sequence
  SiRNA target sequence
ttaattctgcttcccgtagataaaga

SEQ ID NO: 250403 - DNA, 26 bp, Artificial sequence
  SiRNA target sequence
taattctgcttcccgtagataaagaa

SEQ ID NO: 250404 - DNA, 26 bp, Artificial sequence
  SiRNA target sequence
aattctgcttcccgtagataaagaat

SEQ ID NO: 250405 - DNA, 26 bp, Artificial sequence
  SiRNA target sequence
attctgcttcccgtagataaagaatt

SEQ ID NO: 250406 - DNA, 26 bp, Artificial sequence
  SiRNA target sequence
ttctgcttcccgtagataaagaattt

SEQ ID NO: 250407 - DNA, 26 bp, Artificial sequence
  SiRNA target sequence
tctgcttcccgtagataaagaatttt

SEQ ID NO: 250408 - DNA, 26 bp, Artificial sequence
  SiRNA target sequence
ctgcttcccgtagataaagaattttt

SEQ ID NO: 250409 - DNA, 26 bp, Artificial sequence
  SiRNA target sequence
tgcttcccgtagataaagaatttttt

SEQ ID NO: 250410 - DNA, 26 bp, Artificial sequence
  SiRNA target sequence
gcttcccgtagataaagaatttttta

SEQ ID NO: 250411 - DNA, 26 bp, Artificial sequence
  SiRNA target sequence
cttcccgtagataaagaattttttaa

SEQ ID NO: 250412 - DNA, 26 bp, Artificial sequence
  SiRNA target sequence
ttcccgtagataaagaattttttaag

SEQ ID NO: 250413 - DNA, 26 bp, Artificial sequence
  SiRNA target sequence
tcccgtagataaagaattttttaagg

SEQ ID NO: 250414 - DNA, 26 bp, Artificial sequence
  SiRNA target sequence
cccgtagataaagaattttttaagga

SEQ ID NO: 250415 - DNA, 26 bp, Artificial sequence
  SiRNA target sequence
ccgtagataaagaattttttaaggac

SEQ ID NO: 250416 - DNA, 26 bp, Artificial sequence
  SiRNA target sequence
cgtagataaagaattttttaaggaca

SEQ ID NO: 250417 - DNA, 26 bp, Artificial sequence
  SiRNA target sequence
gtagataaagaattttttaaggacat

SEQ ID NO: 250418 - DNA, 26 bp, Artificial sequence
  SiRNA target sequence
tagataaagaattttttaaggacata

SEQ ID NO: 250419 - DNA, 26 bp, Artificial sequence
  SiRNA target sequence
agataaagaattttttaaggacatat

SEQ ID NO: 250420 - DNA, 26 bp, Artificial sequence
  SiRNA target sequence
gataaagaattttttaaggacatatc

SEQ ID NO: 250421 - DNA, 26 bp, Artificial sequence
  SiRNA target sequence
ataaagaattttttaaggacatatca

SEQ ID NO: 250422 - DNA, 26 bp, Artificial sequence
  SiRNA target sequence
taaagaattttttaaggacatatcaa

SEQ ID NO: 250423 - DNA, 26 bp, Artificial sequence
  SiRNA target sequence
aaagaattttttaaggacatatcaat

SEQ ID NO: 250424 - DNA, 26 bp, Artificial sequence
  SiRNA target sequence
aagaattttttaaggacatatcaata

SEQ ID NO: 250425 - DNA, 26 bp, Artificial sequence
  SiRNA target sequence
agaattttttaaggacatatcaataa

SEQ ID NO: 250426 - DNA, 26 bp, Artificial sequence
  SiRNA target sequence
gaattttttaaggacatatcaataaa

SEQ ID NO: 250427 - DNA, 26 bp, Artificial sequence
  SiRNA target sequence
aattttttaaggacatatcaataaat

SEQ ID NO: 250428 - DNA, 26 bp, Artificial sequence
  SiRNA target sequence
attttttaaggacatatcaataaatc

SEQ ID NO: 250429 - DNA, 26 bp, Artificial sequence
  SiRNA target sequence
ttttttaaggacatatcaataaatcc

SEQ ID NO: 250430 - DNA, 26 bp, Artificial sequence
  SiRNA target sequence
tttttaaggacatatcaataaatcct

SEQ ID NO: 250431 - DNA, 26 bp, Artificial sequence
  SiRNA target sequence
ttttaaggacatatcaataaatcctg

SEQ ID NO: 250432 - DNA, 26 bp, Artificial sequence
  SiRNA target sequence
tttaaggacatatcaataaatcctgc

SEQ ID NO: 250433 - DNA, 26 bp, Artificial sequence
  SiRNA target sequence
ttaaggacatatcaataaatcctgca

SEQ ID NO: 250434 - DNA, 26 bp, Artificial sequence
  SiRNA target sequence
taaggacatatcaataaatcctgcat

SEQ ID NO: 250435 - DNA, 26 bp, Artificial sequence
  SiRNA target sequence
aaggacatatcaataaatcctgcatt

SEQ ID NO: 250436 - DNA, 26 bp, Artificial sequence
  SiRNA target sequence
aggacatatcaataaatcctgcatta

SEQ ID NO: 250437 - DNA, 26 bp, Artificial sequence
  SiRNA target sequence
ggacatatcaataaatcctgcattaa

SEQ ID NO: 250438 - DNA, 26 bp, Artificial sequence
  SiRNA target sequence
gacatatcaataaatcctgcattaat

SEQ ID NO: 250439 - DNA, 26 bp, Artificial sequence
  SiRNA target sequence
acatatcaataaatcctgcattaata

SEQ ID NO: 250440 - DNA, 26 bp, Artificial sequence
  SiRNA target sequence
catatcaataaatcctgcattaatag

SEQ ID NO: 250441 - DNA, 26 bp, Artificial sequence
  SiRNA target sequence
atatcaataaatcctgcattaatagc

SEQ ID NO: 250442 - DNA, 26 bp, Artificial sequence
  SiRNA target sequence
tatcaataaatcctgcattaatagca

SEQ ID NO: 250443 - DNA, 26 bp, Artificial sequence
  SiRNA target sequence
atcaataaatcctgcattaatagcat

SEQ ID NO: 250444 - DNA, 26 bp, Artificial sequence
  SiRNA target sequence
tcaataaatcctgcattaatagcata

SEQ ID NO: 250445 - DNA, 26 bp, Artificial sequence
  SiRNA target sequence
caataaatcctgcattaatagcatag

SEQ ID NO: 250446 - DNA, 26 bp, Artificial sequence
  SiRNA target sequence
aataaatcctgcattaatagcataga

SEQ ID NO: 250447 - DNA, 26 bp, Artificial sequence
  SiRNA target sequence
ataaatcctgcattaatagcatagat

SEQ ID NO: 250448 - DNA, 26 bp, Artificial sequence
  SiRNA target sequence
taaatcctgcattaatagcatagatt

SEQ ID NO: 250449 - DNA, 26 bp, Artificial sequence
  SiRNA target sequence
aaatcctgcattaatagcatagatta

SEQ ID NO: 250450 - DNA, 26 bp, Artificial sequence
  SiRNA target sequence
aatcctgcattaatagcatagattaa

SEQ ID NO: 250451 - DNA, 26 bp, Artificial sequence
  SiRNA target sequence
atcctgcattaatagcatagattaat

SEQ ID NO: 250452 - DNA, 26 bp, Artificial sequence
  SiRNA target sequence
tcctgcattaatagcatagattaatg

SEQ ID NO: 250453 - DNA, 26 bp, Artificial sequence
  SiRNA target sequence
cctgcattaatagcatagattaatgc

SEQ ID NO: 250454 - DNA, 26 bp, Artificial sequence
  SiRNA target sequence
ctgcattaatagcatagattaatgcc

SEQ ID NO: 250455 - DNA, 26 bp, Artificial sequence
  SiRNA target sequence
tgcattaatagcatagattaatgccg

SEQ ID NO: 250456 - DNA, 26 bp, Artificial sequence
  SiRNA target sequence
gcattaatagcatagattaatgccgc

SEQ ID NO: 250457 - DNA, 26 bp, Artificial sequence
  SiRNA target sequence
cattaatagcatagattaatgccgct

SEQ ID NO: 250458 - DNA, 26 bp, Artificial sequence
  SiRNA target sequence
attaatagcatagattaatgccgctg

SEQ ID NO: 250459 - DNA, 26 bp, Artificial sequence
  SiRNA target sequence
ttaatagcatagattaatgccgctgc

SEQ ID NO: 250460 - DNA, 26 bp, Artificial sequence
  SiRNA target sequence
taatagcatagattaatgccgctgca

SEQ ID NO: 250461 - DNA, 26 bp, Artificial sequence
  SiRNA target sequence
aatagcatagattaatgccgctgcac

SEQ ID NO: 250462 - DNA, 26 bp, Artificial sequence
  SiRNA target sequence
atagcatagattaatgccgctgcaca

SEQ ID NO: 250463 - DNA, 26 bp, Artificial sequence
  SiRNA target sequence
tagcatagattaatgccgctgcacac

SEQ ID NO: 250464 - DNA, 26 bp, Artificial sequence
  SiRNA target sequence
agcatagattaatgccgctgcacaca

SEQ ID NO: 250465 - DNA, 26 bp, Artificial sequence
  SiRNA target sequence
gcatagattaatgccgctgcacacat

SEQ ID NO: 250466 - DNA, 26 bp, Artificial sequence
  SiRNA target sequence
catagattaatgccgctgcacacata

SEQ ID NO: 250467 - DNA, 26 bp, Artificial sequence
  SiRNA target sequence
atagattaatgccgctgcacacatat

SEQ ID NO: 250468 - DNA, 26 bp, Artificial sequence
  SiRNA target sequence
tagattaatgccgctgcacacatatt

SEQ ID NO: 250469 - DNA, 26 bp, Artificial sequence
  SiRNA target sequence
agattaatgccgctgcacacatattt

SEQ ID NO: 250470 - DNA, 26 bp, Artificial sequence
  SiRNA target sequence
gattaatgccgctgcacacatatttc

SEQ ID NO: 250471 - DNA, 26 bp, Artificial sequence
  SiRNA target sequence
attaatgccgctgcacacatatttct

SEQ ID NO: 250472 - DNA, 26 bp, Artificial sequence
  SiRNA target sequence
ttaatgccgctgcacacatatttctt

SEQ ID NO: 250473 - DNA, 26 bp, Artificial sequence
  SiRNA target sequence
taatgccgctgcacacatatttctta

SEQ ID NO: 250474 - DNA, 26 bp, Artificial sequence
  SiRNA target sequence
aatgccgctgcacacatatttcttaa

SEQ ID NO: 250475 - DNA, 26 bp, Artificial sequence
  SiRNA target sequence
atgccgctgcacacatatttcttaaa

SEQ ID NO: 250476 - DNA, 26 bp, Artificial sequence
  SiRNA target sequence
tgccgctgcacacatatttcttaaaa

SEQ ID NO: 250477 - DNA, 26 bp, Artificial sequence
  SiRNA target sequence
gccgctgcacacatatttcttaaaaa

SEQ ID NO: 250478 - DNA, 26 bp, Artificial sequence
  SiRNA target sequence
ccgctgcacacatatttcttaaaaat

SEQ ID NO: 250479 - DNA, 26 bp, Artificial sequence
  SiRNA target sequence
cgctgcacacatatttcttaaaaatt

SEQ ID NO: 250480 - DNA, 26 bp, Artificial sequence
  SiRNA target sequence
gctgcacacatatttcttaaaaattt

SEQ ID NO: 250481 - DNA, 26 bp, Artificial sequence
  SiRNA target sequence
ctgcacacatatttcttaaaaatttg

SEQ ID NO: 250482 - DNA, 26 bp, Artificial sequence
  SiRNA target sequence
tgcacacatatttcttaaaaatttgg

SEQ ID NO: 250483 - DNA, 26 bp, Artificial sequence
  SiRNA target sequence
gcacacatatttcttaaaaatttgga

SEQ ID NO: 250484 - DNA, 26 bp, Artificial sequence
  SiRNA target sequence
cacacatatttcttaaaaatttggat

SEQ ID NO: 250485 - DNA, 26 bp, Artificial sequence
  SiRNA target sequence
acacatatttcttaaaaatttggatt

SEQ ID NO: 250486 - DNA, 26 bp, Artificial sequence
  SiRNA target sequence
cacatatttcttaaaaatttggattg

SEQ ID NO: 250487 - DNA, 26 bp, Artificial sequence
  SiRNA target sequence
acatatttcttaaaaatttggattgt

SEQ ID NO: 250488 - DNA, 26 bp, Artificial sequence
  SiRNA target sequence
catatttcttaaaaatttggattgta

SEQ ID NO: 250489 - DNA, 26 bp, Artificial sequence
  SiRNA target sequence
atatttcttaaaaatttggattgtaa

SEQ ID NO: 250490 - DNA, 26 bp, Artificial sequence
  SiRNA target sequence
tatttcttaaaaatttggattgtaaa

SEQ ID NO: 250491 - DNA, 26 bp, Artificial sequence
  SiRNA target sequence
atttcttaaaaatttggattgtaaaa

SEQ ID NO: 250492 - DNA, 26 bp, Artificial sequence
  SiRNA target sequence
tttcttaaaaatttggattgtaaaag

SEQ ID NO: 250493 - DNA, 26 bp, Artificial sequence
  SiRNA target sequence
ttcttaaaaatttggattgtaaaaga

SEQ ID NO: 250494 - DNA, 26 bp, Artificial sequence
  SiRNA target sequence
tcttaaaaatttggattgtaaaagat

SEQ ID NO: 250495 - DNA, 26 bp, Artificial sequence
  SiRNA target sequence
cttaaaaatttggattgtaaaagatc

SEQ ID NO: 250496 - DNA, 26 bp, Artificial sequence
  SiRNA target sequence
ttaaaaatttggattgtaaaagatca

SEQ ID NO: 250497 - DNA, 26 bp, Artificial sequence
  SiRNA target sequence
taaaaatttggattgtaaaagatcaa

SEQ ID NO: 250498 - DNA, 26 bp, Artificial sequence
  SiRNA target sequence
aaaaatttggattgtaaaagatcaaa

SEQ ID NO: 250499 - DNA, 26 bp, Artificial sequence
  SiRNA target sequence
aaaatttggattgtaaaagatcaaac

SEQ ID NO: 250500 - DNA, 26 bp, Artificial sequence
  SiRNA target sequence
aaatttggattgtaaaagatcaaacg

SEQ ID NO: 250501 - DNA, 26 bp, Artificial sequence
  SiRNA target sequence
aatttggattgtaaaagatcaaacga

SEQ ID NO: 250502 - DNA, 26 bp, Artificial sequence
  SiRNA target sequence
atttggattgtaaaagatcaaacgag

SEQ ID NO: 250503 - DNA, 26 bp, Artificial sequence
  SiRNA target sequence
tttggattgtaaaagatcaaacgagg

SEQ ID NO: 250504 - DNA, 26 bp, Artificial sequence
  SiRNA target sequence
ttggattgtaaaagatcaaacgagga

SEQ ID NO: 250505 - DNA, 26 bp, Artificial sequence
  SiRNA target sequence
tggattgtaaaagatcaaacgaggat

SEQ ID NO: 250506 - DNA, 26 bp, Artificial sequence
  SiRNA target sequence
ggattgtaaaagatcaaacgaggatg

SEQ ID NO: 250507 - DNA, 26 bp, Artificial sequence
  SiRNA target sequence
gattgtaaaagatcaaacgaggatgt

SEQ ID NO: 250508 - DNA, 26 bp, Artificial sequence
  SiRNA target sequence
attgtaaaagatcaaacgaggatgtc

SEQ ID NO: 250509 - DNA, 26 bp, Artificial sequence
  SiRNA target sequence
ttgtaaaagatcaaacgaggatgtcg

SEQ ID NO: 250510 - DNA, 26 bp, Artificial sequence
  SiRNA target sequence
tgtaaaagatcaaacgaggatgtcgt

SEQ ID NO: 250511 - DNA, 26 bp, Artificial sequence
  SiRNA target sequence
gtaaaagatcaaacgaggatgtcgtt

SEQ ID NO: 250512 - DNA, 26 bp, Artificial sequence
  SiRNA target sequence
taaaagatcaaacgaggatgtcgttt

SEQ ID NO: 250513 - DNA, 26 bp, Artificial sequence
  SiRNA target sequence
aaaagatcaaacgaggatgtcgtttt

SEQ ID NO: 250514 - DNA, 26 bp, Artificial sequence
  SiRNA target sequence
aaagatcaaacgaggatgtcgttttg

SEQ ID NO: 250515 - DNA, 26 bp, Artificial sequence
  SiRNA target sequence
aagatcaaacgaggatgtcgttttgt

SEQ ID NO: 250516 - DNA, 26 bp, Artificial sequence
  SiRNA target sequence
agatcaaacgaggatgtcgttttgtc

SEQ ID NO: 250517 - DNA, 26 bp, Artificial sequence
  SiRNA target sequence
gatcaaacgaggatgtcgttttgtct

SEQ ID NO: 250518 - DNA, 26 bp, Artificial sequence
  SiRNA target sequence
atcaaacgaggatgtcgttttgtctt

SEQ ID NO: 250519 - DNA, 26 bp, Artificial sequence
  SiRNA target sequence
tcaaacgaggatgtcgttttgtcttc

SEQ ID NO: 250520 - DNA, 26 bp, Artificial sequence
  SiRNA target sequence
caaacgaggatgtcgttttgtcttct

SEQ ID NO: 250521 - DNA, 26 bp, Artificial sequence
  SiRNA target sequence
aaacgaggatgtcgttttgtcttctt

SEQ ID NO: 250522 - DNA, 26 bp, Artificial sequence
  SiRNA target sequence
aacgaggatgtcgttttgtcttcttc

SEQ ID NO: 250523 - DNA, 26 bp, Artificial sequence
  SiRNA target sequence
acgaggatgtcgttttgtcttcttct

SEQ ID NO: 250524 - DNA, 26 bp, Artificial sequence
  SiRNA target sequence
cgaggatgtcgttttgtcttcttctt

SEQ ID NO: 250525 - DNA, 26 bp, Artificial sequence
  SiRNA target sequence
gaggatgtcgttttgtcttcttcttt

SEQ ID NO: 250526 - DNA, 26 bp, Artificial sequence
  SiRNA target sequence
aggatgtcgttttgtcttcttcttta

SEQ ID NO: 250527 - DNA, 26 bp, Artificial sequence
  SiRNA target sequence
ggatgtcgttttgtcttcttctttat

SEQ ID NO: 250528 - DNA, 26 bp, Artificial sequence
  SiRNA target sequence
gatgtcgttttgtcttcttctttatt

SEQ ID NO: 250529 - DNA, 26 bp, Artificial sequence
  SiRNA target sequence
atgtcgttttgtcttcttctttattt

SEQ ID NO: 250530 - DNA, 26 bp, Artificial sequence
  SiRNA target sequence
tgtcgttttgtcttcttctttattta

SEQ ID NO: 250531 - DNA, 26 bp, Artificial sequence
  SiRNA target sequence
gtcgttttgtcttcttctttatttat

SEQ ID NO: 250532 - DNA, 26 bp, Artificial sequence
  SiRNA target sequence
tcgttttgtcttcttctttatttata

SEQ ID NO: 250533 - DNA, 26 bp, Artificial sequence
  SiRNA target sequence
cgttttgtcttcttctttatttatag

SEQ ID NO: 250534 - DNA, 26 bp, Artificial sequence
  SiRNA target sequence
gttttgtcttcttctttatttatagt

SEQ ID NO: 250535 - DNA, 26 bp, Artificial sequence
  SiRNA target sequence
ttttgtcttcttctttatttatagtt

SEQ ID NO: 250536 - DNA, 26 bp, Artificial sequence
  SiRNA target sequence
tttgtcttcttctttatttatagttt

SEQ ID NO: 250537 - DNA, 26 bp, Artificial sequence
  SiRNA target sequence
ttgtcttcttctttatttatagtttc

SEQ ID NO: 250538 - DNA, 26 bp, Artificial sequence
  SiRNA target sequence
tgtcttcttctttatttatagtttcc

SEQ ID NO: 250539 - DNA, 26 bp, Artificial sequence
  SiRNA target sequence
gtcttcttctttatttatagtttcct

SEQ ID NO: 250540 - DNA, 26 bp, Artificial sequence
  SiRNA target sequence
tcttcttctttatttatagtttcctt

SEQ ID NO: 250541 - DNA, 26 bp, Artificial sequence
  SiRNA target sequence
cttcttctttatttatagtttccttt

SEQ ID NO: 250542 - DNA, 26 bp, Artificial sequence
  SiRNA target sequence
ttcttctttatttatagtttccttta

SEQ ID NO: 250543 - DNA, 26 bp, Artificial sequence
  SiRNA target sequence
tcttctttatttatagtttcctttat

SEQ ID NO: 250544 - DNA, 26 bp, Artificial sequence
  SiRNA target sequence
cttctttatttatagtttcctttatt

SEQ ID NO: 250545 - DNA, 26 bp, Artificial sequence
  SiRNA target sequence
ttctttatttatagtttcctttattt

SEQ ID NO: 250546 - DNA, 26 bp, Artificial sequence
  SiRNA target sequence
tctttatttatagtttcctttatttc

SEQ ID NO: 250547 - DNA, 26 bp, Artificial sequence
  SiRNA target sequence
ctttatttatagtttcctttatttct

SEQ ID NO: 250548 - DNA, 26 bp, Artificial sequence
  SiRNA target sequence
tttatttatagtttcctttatttctt

SEQ ID NO: 250549 - DNA, 26 bp, Artificial sequence
  SiRNA target sequence
ttatttatagtttcctttatttcttt

SEQ ID NO: 250550 - DNA, 26 bp, Artificial sequence
  SiRNA target sequence
tatttatagtttcctttatttcttta

SEQ ID NO: 250551 - DNA, 26 bp, Artificial sequence
  SiRNA target sequence
atttatagtttcctttatttctttag

SEQ ID NO: 250552 - DNA, 26 bp, Artificial sequence
  SiRNA target sequence
tttatagtttcctttatttctttagt

SEQ ID NO: 250553 - DNA, 26 bp, Artificial sequence
  SiRNA target sequence
ttatagtttcctttatttctttagtt

SEQ ID NO: 250554 - DNA, 26 bp, Artificial sequence
  SiRNA target sequence
tatagtttcctttatttctttagttt

SEQ ID NO: 250555 - DNA, 26 bp, Artificial sequence
  SiRNA target sequence
atagtttcctttatttctttagtttt

SEQ ID NO: 250556 - DNA, 26 bp, Artificial sequence
  SiRNA target sequence
tagtttcctttatttctttagtttta

SEQ ID NO: 250557 - DNA, 26 bp, Artificial sequence
  SiRNA target sequence
agtttcctttatttctttagttttaa

SEQ ID NO: 250558 - DNA, 26 bp, Artificial sequence
  SiRNA target sequence
gtttcctttatttctttagttttaag

SEQ ID NO: 250559 - DNA, 26 bp, Artificial sequence
  SiRNA target sequence
tttcctttatttctttagttttaaga

SEQ ID NO: 250560 - DNA, 26 bp, Artificial sequence
  SiRNA target sequence
ttcctttatttctttagttttaagag

SEQ ID NO: 250561 - DNA, 26 bp, Artificial sequence
  SiRNA target sequence
tcctttatttctttagttttaagagg

SEQ ID NO: 250562 - DNA, 26 bp, Artificial sequence
  SiRNA target sequence
cctttatttctttagttttaagagga

SEQ ID NO: 250563 - DNA, 26 bp, Artificial sequence
  SiRNA target sequence
ctttatttctttagttttaagaggaa

SEQ ID NO: 250564 - DNA, 26 bp, Artificial sequence
  SiRNA target sequence
tttatttctttagttttaagaggaat

SEQ ID NO: 250565 - DNA, 26 bp, Artificial sequence
  SiRNA target sequence
ttatttctttagttttaagaggaata

SEQ ID NO: 250566 - DNA, 26 bp, Artificial sequence
  SiRNA target sequence
tatttctttagttttaagaggaatat

SEQ ID NO: 250567 - DNA, 26 bp, Artificial sequence
  SiRNA target sequence
atttctttagttttaagaggaatata

SEQ ID NO: 250568 - DNA, 26 bp, Artificial sequence
  SiRNA target sequence
tttctttagttttaagaggaatataa

SEQ ID NO: 250569 - DNA, 26 bp, Artificial sequence
  SiRNA target sequence
ttctttagttttaagaggaatataac

SEQ ID NO: 250570 - DNA, 26 bp, Artificial sequence
  SiRNA target sequence
tctttagttttaagaggaatataact

SEQ ID NO: 250571 - DNA, 26 bp, Artificial sequence
  SiRNA target sequence
ctttagttttaagaggaatataactt

SEQ ID NO: 250572 - DNA, 26 bp, Artificial sequence
  SiRNA target sequence
tttagttttaagaggaatataacttt

SEQ ID NO: 250573 - DNA, 26 bp, Artificial sequence
  SiRNA target sequence
ttagttttaagaggaatataactttt

SEQ ID NO: 250574 - DNA, 26 bp, Artificial sequence
  SiRNA target sequence
tagttttaagaggaatataacttttt

SEQ ID NO: 250575 - DNA, 26 bp, Artificial sequence
  SiRNA target sequence
agttttaagaggaatataacttttta

SEQ ID NO: 250576 - DNA, 26 bp, Artificial sequence
  SiRNA target sequence
gttttaagaggaatataactttttaa

SEQ ID NO: 250577 - DNA, 26 bp, Artificial sequence
  SiRNA target sequence
ttttaagaggaatataactttttaaa

SEQ ID NO: 250578 - DNA, 26 bp, Artificial sequence
  SiRNA target sequence
tttaagaggaatataactttttaaaa

SEQ ID NO: 250579 - DNA, 26 bp, Artificial sequence
  SiRNA target sequence
ttaagaggaatataactttttaaaaa

SEQ ID NO: 250580 - DNA, 26 bp, Artificial sequence
  SiRNA target sequence
taagaggaatataactttttaaaaag

SEQ ID NO: 250581 - DNA, 26 bp, Artificial sequence
  SiRNA target sequence
aagaggaatataactttttaaaaagt

SEQ ID NO: 250582 - DNA, 26 bp, Artificial sequence
  SiRNA target sequence
agaggaatataactttttaaaaagta

SEQ ID NO: 250583 - DNA, 26 bp, Artificial sequence
  SiRNA target sequence
gaggaatataactttttaaaaagtaa

SEQ ID NO: 250584 - DNA, 26 bp, Artificial sequence
  SiRNA target sequence
aggaatataactttttaaaaagtaaa

SEQ ID NO: 250585 - DNA, 26 bp, Artificial sequence
  SiRNA target sequence
ggaatataactttttaaaaagtaaat

SEQ ID NO: 250586 - DNA, 26 bp, Artificial sequence
  SiRNA target sequence
gaatataactttttaaaaagtaaatt

SEQ ID NO: 250587 - DNA, 26 bp, Artificial sequence
  SiRNA target sequence
aatataactttttaaaaagtaaatta

SEQ ID NO: 250588 - DNA, 26 bp, Artificial sequence
  SiRNA target sequence
atataactttttaaaaagtaaattaa

SEQ ID NO: 250589 - DNA, 26 bp, Artificial sequence
  SiRNA target sequence
tataactttttaaaaagtaaattaat

SEQ ID NO: 250590 - DNA, 26 bp, Artificial sequence
  SiRNA target sequence
ataactttttaaaaagtaaattaatg

SEQ ID NO: 250591 - DNA, 26 bp, Artificial sequence
  SiRNA target sequence
taactttttaaaaagtaaattaatgt

SEQ ID NO: 250592 - DNA, 26 bp, Artificial sequence
  SiRNA target sequence
aactttttaaaaagtaaattaatgta

SEQ ID NO: 250593 - DNA, 26 bp, Artificial sequence
  SiRNA target sequence
actttttaaaaagtaaattaatgtag

SEQ ID NO: 250594 - DNA, 26 bp, Artificial sequence
  SiRNA target sequence
ctttttaaaaagtaaattaatgtagt

SEQ ID NO: 250595 - DNA, 26 bp, Artificial sequence
  SiRNA target sequence
tttttaaaaagtaaattaatgtagtt

SEQ ID NO: 250596 - DNA, 26 bp, Artificial sequence
  SiRNA target sequence
ttttaaaaagtaaattaatgtagtta

SEQ ID NO: 250597 - DNA, 26 bp, Artificial sequence
  SiRNA target sequence
tttaaaaagtaaattaatgtagttac

SEQ ID NO: 250598 - DNA, 26 bp, Artificial sequence
  SiRNA target sequence
ttaaaaagtaaattaatgtagttaca

SEQ ID NO: 250599 - DNA, 26 bp, Artificial sequence
  SiRNA target sequence
taaaaagtaaattaatgtagttacaa

SEQ ID NO: 250600 - DNA, 26 bp, Artificial sequence
  SiRNA target sequence
aaaaagtaaattaatgtagttacaaa

SEQ ID NO: 250601 - DNA, 26 bp, Artificial sequence
  SiRNA target sequence
aaaagtaaattaatgtagttacaaaa

SEQ ID NO: 250602 - DNA, 26 bp, Artificial sequence
  SiRNA target sequence
aaagtaaattaatgtagttacaaaag

SEQ ID NO: 250603 - DNA, 26 bp, Artificial sequence
  SiRNA target sequence
aagtaaattaatgtagttacaaaaga

SEQ ID NO: 250604 - DNA, 26 bp, Artificial sequence
  SiRNA target sequence
agtaaattaatgtagttacaaaagac

SEQ ID NO: 250605 - DNA, 26 bp, Artificial sequence
  SiRNA target sequence
gtaaattaatgtagttacaaaagaca

SEQ ID NO: 250606 - DNA, 26 bp, Artificial sequence
  SiRNA target sequence
taaattaatgtagttacaaaagacaa

SEQ ID NO: 250607 - DNA, 26 bp, Artificial sequence
  SiRNA target sequence
aaattaatgtagttacaaaagacaag

SEQ ID NO: 250608 - DNA, 26 bp, Artificial sequence
  SiRNA target sequence
aattaatgtagttacaaaagacaaga

SEQ ID NO: 250609 - DNA, 26 bp, Artificial sequence
  SiRNA target sequence
attaatgtagttacaaaagacaagat

SEQ ID NO: 250610 - DNA, 26 bp, Artificial sequence
  SiRNA target sequence
ttaatgtagttacaaaagacaagatc

SEQ ID NO: 250611 - DNA, 26 bp, Artificial sequence
  SiRNA target sequence
taatgtagttacaaaagacaagatca

SEQ ID NO: 250612 - DNA, 26 bp, Artificial sequence
  SiRNA target sequence
aatgtagttacaaaagacaagatcaa

SEQ ID NO: 250613 - DNA, 26 bp, Artificial sequence
  SiRNA target sequence
atgtagttacaaaagacaagatcaaa

SEQ ID NO: 250614 - DNA, 26 bp, Artificial sequence
  SiRNA target sequence
tgtagttacaaaagacaagatcaaaa

SEQ ID NO: 250615 - DNA, 26 bp, Artificial sequence
  SiRNA target sequence
gtagttacaaaagacaagatcaaaaa

SEQ ID NO: 250616 - DNA, 26 bp, Artificial sequence
  SiRNA target sequence
tagttacaaaagacaagatcaaaaaa

SEQ ID NO: 250617 - DNA, 26 bp, Artificial sequence
  SiRNA target sequence
agttacaaaagacaagatcaaaaaaa

SEQ ID NO: 250618 - DNA, 26 bp, Artificial sequence
  SiRNA target sequence
gttacaaaagacaagatcaaaaaaaa

SEQ ID NO: 250619 - DNA, 26 bp, Artificial sequence
  SiRNA target sequence
ttacaaaagacaagatcaaaaaaaac

SEQ ID NO: 250620 - DNA, 26 bp, Artificial sequence
  SiRNA target sequence
tacaaaagacaagatcaaaaaaaaca

SEQ ID NO: 250621 - DNA, 26 bp, Artificial sequence
  SiRNA target sequence
acaaaagacaagatcaaaaaaaacaa

SEQ ID NO: 250622 - DNA, 26 bp, Artificial sequence
  SiRNA target sequence
caaaagacaagatcaaaaaaaacaaa

SEQ ID NO: 250623 - DNA, 26 bp, Artificial sequence
  SiRNA target sequence
aaaagacaagatcaaaaaaaacaaac

SEQ ID NO: 250624 - DNA, 26 bp, Artificial sequence
  SiRNA target sequence
aaagacaagatcaaaaaaaacaaact

SEQ ID NO: 250625 - DNA, 26 bp, Artificial sequence
  SiRNA target sequence
aagacaagatcaaaaaaaacaaacta

SEQ ID NO: 250626 - DNA, 26 bp, Artificial sequence
  SiRNA target sequence
agacaagatcaaaaaaaacaaactac

SEQ ID NO: 250627 - DNA, 26 bp, Artificial sequence
  SiRNA target sequence
gacaagatcaaaaaaaacaaactact

SEQ ID NO: 250628 - DNA, 26 bp, Artificial sequence
  SiRNA target sequence
acaagatcaaaaaaaacaaactacta

SEQ ID NO: 250629 - DNA, 26 bp, Artificial sequence
  SiRNA target sequence
caagatcaaaaaaaacaaactactac

SEQ ID NO: 250630 - DNA, 26 bp, Artificial sequence
  SiRNA target sequence
aagatcaaaaaaaacaaactactacc

SEQ ID NO: 250631 - DNA, 26 bp, Artificial sequence
  SiRNA target sequence
agatcaaaaaaaacaaactactaccg

SEQ ID NO: 250632 - DNA, 26 bp, Artificial sequence
  SiRNA target sequence
gatcaaaaaaaacaaactactaccgt

SEQ ID NO: 250633 - DNA, 26 bp, Artificial sequence
  SiRNA target sequence
atcaaaaaaaacaaactactaccgtc

SEQ ID NO: 250634 - DNA, 26 bp, Artificial sequence
  SiRNA target sequence
tcaaaaaaaacaaactactaccgtca

SEQ ID NO: 250635 - DNA, 26 bp, Artificial sequence
  SiRNA target sequence
caaaaaaaacaaactactaccgtcaa

SEQ ID NO: 250636 - DNA, 26 bp, Artificial sequence
  SiRNA target sequence
aaaaaaaacaaactactaccgtcaat

SEQ ID NO: 250637 - DNA, 26 bp, Artificial sequence
  SiRNA target sequence
aaaaaaacaaactactaccgtcaatt

SEQ ID NO: 250638 - DNA, 26 bp, Artificial sequence
  SiRNA target sequence
aaaaaacaaactactaccgtcaattt

SEQ ID NO: 250639 - DNA, 26 bp, Artificial sequence
  SiRNA target sequence
aaaaacaaactactaccgtcaatttt

SEQ ID NO: 250640 - DNA, 26 bp, Artificial sequence
  SiRNA target sequence
aaaacaaactactaccgtcaatttta

SEQ ID NO: 250641 - DNA, 26 bp, Artificial sequence
  SiRNA target sequence
aaacaaactactaccgtcaattttat

SEQ ID NO: 250642 - DNA, 26 bp, Artificial sequence
  SiRNA target sequence
aacaaactactaccgtcaattttatc

SEQ ID NO: 250643 - DNA, 26 bp, Artificial sequence
  SiRNA target sequence
acaaactactaccgtcaattttatca

SEQ ID NO: 250644 - DNA, 26 bp, Artificial sequence
  SiRNA target sequence
caaactactaccgtcaattttatcat

SEQ ID NO: 250645 - DNA, 26 bp, Artificial sequence
  SiRNA target sequence
aaactactaccgtcaattttatcatg

SEQ ID NO: 250646 - DNA, 26 bp, Artificial sequence
  SiRNA target sequence
aactactaccgtcaattttatcatgc

SEQ ID NO: 250647 - DNA, 26 bp, Artificial sequence
  SiRNA target sequence
actactaccgtcaattttatcatgca

SEQ ID NO: 250648 - DNA, 26 bp, Artificial sequence
  SiRNA target sequence
ctactaccgtcaattttatcatgcaa

SEQ ID NO: 250649 - DNA, 26 bp, Artificial sequence
  SiRNA target sequence
tactaccgtcaattttatcatgcaaa

SEQ ID NO: 250650 - DNA, 26 bp, Artificial sequence
  SiRNA target sequence
actaccgtcaattttatcatgcaaac

SEQ ID NO: 250651 - DNA, 26 bp, Artificial sequence
  SiRNA target sequence
ctaccgtcaattttatcatgcaaacc

SEQ ID NO: 250652 - DNA, 26 bp, Artificial sequence
  SiRNA target sequence
taccgtcaattttatcatgcaaacct

SEQ ID NO: 250653 - DNA, 26 bp, Artificial sequence
  SiRNA target sequence
accgtcaattttatcatgcaaacctg

SEQ ID NO: 250654 - DNA, 26 bp, Artificial sequence
  SiRNA target sequence
ccgtcaattttatcatgcaaacctgc

SEQ ID NO: 250655 - DNA, 26 bp, Artificial sequence
  SiRNA target sequence
cgtcaattttatcatgcaaacctgca

SEQ ID NO: 250656 - DNA, 26 bp, Artificial sequence
  SiRNA target sequence
gtcaattttatcatgcaaacctgcag

SEQ ID NO: 250657 - DNA, 26 bp, Artificial sequence
  SiRNA target sequence
tcaattttatcatgcaaacctgcagg

SEQ ID NO: 250658 - DNA, 26 bp, Artificial sequence
  SiRNA target sequence
caattttatcatgcaaacctgcagga

SEQ ID NO: 250659 - DNA, 26 bp, Artificial sequence
  SiRNA target sequence
aattttatcatgcaaacctgcaggaa

SEQ ID NO: 250660 - DNA, 26 bp, Artificial sequence
  SiRNA target sequence
attttatcatgcaaacctgcaggaag

SEQ ID NO: 250661 - DNA, 26 bp, Artificial sequence
  SiRNA target sequence
ttttatcatgcaaacctgcaggaagt

SEQ ID NO: 250662 - DNA, 26 bp, Artificial sequence
  SiRNA target sequence
tttatcatgcaaacctgcaggaagta

SEQ ID NO: 250663 - DNA, 26 bp, Artificial sequence
  SiRNA target sequence
ttatcatgcaaacctgcaggaagtat

SEQ ID NO: 250664 - DNA, 26 bp, Artificial sequence
  SiRNA target sequence
tatcatgcaaacctgcaggaagtata

SEQ ID NO: 250665 - DNA, 26 bp, Artificial sequence
  SiRNA target sequence
atcatgcaaacctgcaggaagtatat

SEQ ID NO: 250666 - DNA, 26 bp, Artificial sequence
  SiRNA target sequence
tcatgcaaacctgcaggaagtatatt

SEQ ID NO: 250667 - DNA, 26 bp, Artificial sequence
  SiRNA target sequence
catgcaaacctgcaggaagtatattt

SEQ ID NO: 250668 - DNA, 26 bp, Artificial sequence
  SiRNA target sequence
atgcaaacctgcaggaagtatatttg

SEQ ID NO: 250669 - DNA, 26 bp, Artificial sequence
  SiRNA target sequence
tgcaaacctgcaggaagtatatttgc

SEQ ID NO: 250670 - DNA, 26 bp, Artificial sequence
  SiRNA target sequence
gcaaacctgcaggaagtatatttgct

SEQ ID NO: 250671 - DNA, 26 bp, Artificial sequence
  SiRNA target sequence
caaacctgcaggaagtatatttgcta

SEQ ID NO: 250672 - DNA, 26 bp, Artificial sequence
  SiRNA target sequence
aaacctgcaggaagtatatttgctaa

SEQ ID NO: 250673 - DNA, 26 bp, Artificial sequence
  SiRNA target sequence
aacctgcaggaagtatatttgctaat

SEQ ID NO: 250674 - DNA, 26 bp, Artificial sequence
  SiRNA target sequence
acctgcaggaagtatatttgctaatt

SEQ ID NO: 250675 - DNA, 26 bp, Artificial sequence
  SiRNA target sequence
cctgcaggaagtatatttgctaattc

SEQ ID NO: 250676 - DNA, 26 bp, Artificial sequence
  SiRNA target sequence
ctgcaggaagtatatttgctaattca

SEQ ID NO: 250677 - DNA, 26 bp, Artificial sequence
  SiRNA target sequence
tgcaggaagtatatttgctaattcat

SEQ ID NO: 250678 - DNA, 26 bp, Artificial sequence
  SiRNA target sequence
gcaggaagtatatttgctaattcatc

SEQ ID NO: 250679 - DNA, 26 bp, Artificial sequence
  SiRNA target sequence
caggaagtatatttgctaattcatct

SEQ ID NO: 250680 - DNA, 26 bp, Artificial sequence
  SiRNA target sequence
aggaagtatatttgctaattcatctt

SEQ ID NO: 250681 - DNA, 26 bp, Artificial sequence
  SiRNA target sequence
ggaagtatatttgctaattcatcttt

SEQ ID NO: 250682 - DNA, 26 bp, Artificial sequence
  SiRNA target sequence
gaagtatatttgctaattcatctttt

SEQ ID NO: 250683 - DNA, 26 bp, Artificial sequence
  SiRNA target sequence
aagtatatttgctaattcatctttta

SEQ ID NO: 250684 - DNA, 26 bp, Artificial sequence
  SiRNA target sequence
agtatatttgctaattcatcttttat

SEQ ID NO: 250685 - DNA, 26 bp, Artificial sequence
  SiRNA target sequence
gtatatttgctaattcatcttttata

SEQ ID NO: 250686 - DNA, 26 bp, Artificial sequence
  SiRNA target sequence
tatatttgctaattcatcttttatat

SEQ ID NO: 250687 - DNA, 26 bp, Artificial sequence
  SiRNA target sequence
atatttgctaattcatcttttatata

SEQ ID NO: 250688 - DNA, 26 bp, Artificial sequence
  SiRNA target sequence
tatttgctaattcatcttttatataa

SEQ ID NO: 250689 - DNA, 26 bp, Artificial sequence
  SiRNA target sequence
atttgctaattcatcttttatataaa

SEQ ID NO: 250690 - DNA, 26 bp, Artificial sequence
  SiRNA target sequence
tttgctaattcatcttttatataaat

SEQ ID NO: 250691 - DNA, 26 bp, Artificial sequence
  SiRNA target sequence
ttgctaattcatcttttatataaata

SEQ ID NO: 250692 - DNA, 26 bp, Artificial sequence
  SiRNA target sequence
tgctaattcatcttttatataaataa

SEQ ID NO: 250693 - DNA, 26 bp, Artificial sequence
  SiRNA target sequence
gctaattcatcttttatataaataaa

SEQ ID NO: 250694 - DNA, 26 bp, Artificial sequence
  SiRNA target sequence
ctaattcatcttttatataaataaaa

SEQ ID NO: 250695 - DNA, 26 bp, Artificial sequence
  SiRNA target sequence
taattcatcttttatataaataaaag

SEQ ID NO: 250696 - DNA, 26 bp, Artificial sequence
  SiRNA target sequence
aattcatcttttatataaataaaagc

SEQ ID NO: 250697 - DNA, 26 bp, Artificial sequence
  SiRNA target sequence
attcatcttttatataaataaaagct

SEQ ID NO: 250698 - DNA, 26 bp, Artificial sequence
  SiRNA target sequence
ttcatcttttatataaataaaagcta

SEQ ID NO: 250699 - DNA, 26 bp, Artificial sequence
  SiRNA target sequence
tcatcttttatataaataaaagctac

SEQ ID NO: 250700 - DNA, 26 bp, Artificial sequence
  SiRNA target sequence
catcttttatataaataaaagctaca

SEQ ID NO: 250701 - DNA, 26 bp, Artificial sequence
  SiRNA target sequence
atcttttatataaataaaagctacag

SEQ ID NO: 250702 - DNA, 26 bp, Artificial sequence
  SiRNA target sequence
tcttttatataaataaaagctacaga

SEQ ID NO: 250703 - DNA, 26 bp, Artificial sequence
  SiRNA target sequence
cttttatataaataaaagctacagaa

SEQ ID NO: 250704 - DNA, 26 bp, Artificial sequence
  SiRNA target sequence
ttttatataaataaaagctacagaaa

SEQ ID NO: 250705 - DNA, 26 bp, Artificial sequence
  SiRNA target sequence
tttatataaataaaagctacagaaat

SEQ ID NO: 250706 - DNA, 26 bp, Artificial sequence
  SiRNA target sequence
ttatataaataaaagctacagaaata

SEQ ID NO: 250707 - DNA, 26 bp, Artificial sequence
  SiRNA target sequence
tatataaataaaagctacagaaataa

SEQ ID NO: 250708 - DNA, 26 bp, Artificial sequence
  SiRNA target sequence
atataaataaaagctacagaaataat

SEQ ID NO: 250709 - DNA, 26 bp, Artificial sequence
  SiRNA target sequence
tataaataaaagctacagaaataatc

SEQ ID NO: 250710 - DNA, 26 bp, Artificial sequence
  SiRNA target sequence
ataaataaaagctacagaaataatca

SEQ ID NO: 250711 - DNA, 26 bp, Artificial sequence
  SiRNA target sequence
taaataaaagctacagaaataatcat

SEQ ID NO: 250712 - DNA, 26 bp, Artificial sequence
  SiRNA target sequence
aaataaaagctacagaaataatcatt

SEQ ID NO: 250713 - DNA, 26 bp, Artificial sequence
  SiRNA target sequence
aataaaagctacagaaataatcattg

SEQ ID NO: 250714 - DNA, 26 bp, Artificial sequence
  SiRNA target sequence
ataaaagctacagaaataatcattga

SEQ ID NO: 250715 - DNA, 26 bp, Artificial sequence
  SiRNA target sequence
taaaagctacagaaataatcattgaa

SEQ ID NO: 250716 - DNA, 26 bp, Artificial sequence
  SiRNA target sequence
aaaagctacagaaataatcattgaaa

SEQ ID NO: 250717 - DNA, 26 bp, Artificial sequence
  SiRNA target sequence
aaagctacagaaataatcattgaaat

SEQ ID NO: 250718 - DNA, 26 bp, Artificial sequence
  SiRNA target sequence
aagctacagaaataatcattgaaatg

SEQ ID NO: 250719 - DNA, 26 bp, Artificial sequence
  SiRNA target sequence
agctacagaaataatcattgaaatgg

SEQ ID NO: 250720 - DNA, 26 bp, Artificial sequence
  SiRNA target sequence
gctacagaaataatcattgaaatggc

SEQ ID NO: 250721 - DNA, 26 bp, Artificial sequence
  SiRNA target sequence
ctacagaaataatcattgaaatggcg

SEQ ID NO: 250722 - DNA, 26 bp, Artificial sequence
  SiRNA target sequence
tacagaaataatcattgaaatggcgg

SEQ ID NO: 250723 - DNA, 26 bp, Artificial sequence
  SiRNA target sequence
acagaaataatcattgaaatggcggt

SEQ ID NO: 250724 - DNA, 26 bp, Artificial sequence
  SiRNA target sequence
cagaaataatcattgaaatggcggtg

SEQ ID NO: 250725 - DNA, 26 bp, Artificial sequence
  SiRNA target sequence
agaaataatcattgaaatggcggtga

SEQ ID NO: 250726 - DNA, 26 bp, Artificial sequence
  SiRNA target sequence
gaaataatcattgaaatggcggtgat

SEQ ID NO: 250727 - DNA, 26 bp, Artificial sequence
  SiRNA target sequence
aaataatcattgaaatggcggtgatt

SEQ ID NO: 250728 - DNA, 26 bp, Artificial sequence
  SiRNA target sequence
aataatcattgaaatggcggtgattg

SEQ ID NO: 250729 - DNA, 26 bp, Artificial sequence
  SiRNA target sequence
ataatcattgaaatggcggtgattgt

SEQ ID NO: 250730 - DNA, 26 bp, Artificial sequence
  SiRNA target sequence
taatcattgaaatggcggtgattgtg

SEQ ID NO: 250731 - DNA, 26 bp, Artificial sequence
  SiRNA target sequence
aatcattgaaatggcggtgattgtgg

SEQ ID NO: 250732 - DNA, 26 bp, Artificial sequence
  SiRNA target sequence
atcattgaaatggcggtgattgtgga

SEQ ID NO: 250733 - DNA, 26 bp, Artificial sequence
  SiRNA target sequence
tcattgaaatggcggtgattgtggaa

SEQ ID NO: 250734 - DNA, 26 bp, Artificial sequence
  SiRNA target sequence
cattgaaatggcggtgattgtggaaa

SEQ ID NO: 250735 - DNA, 26 bp, Artificial sequence
  SiRNA target sequence
attgaaatggcggtgattgtggaaaa

SEQ ID NO: 250736 - DNA, 26 bp, Artificial sequence
  SiRNA target sequence
ttgaaatggcggtgattgtggaaaaa

SEQ ID NO: 250737 - DNA, 26 bp, Artificial sequence
  SiRNA target sequence
tgaaatggcggtgattgtggaaaaat

SEQ ID NO: 250738 - DNA, 26 bp, Artificial sequence
  SiRNA target sequence
gaaatggcggtgattgtggaaaaatt

SEQ ID NO: 250739 - DNA, 26 bp, Artificial sequence
  SiRNA target sequence
aaatggcggtgattgtggaaaaatta

SEQ ID NO: 250740 - DNA, 26 bp, Artificial sequence
  SiRNA target sequence
aatggcggtgattgtggaaaaattag

SEQ ID NO: 250741 - DNA, 26 bp, Artificial sequence
  SiRNA target sequence
atggcggtgattgtggaaaaattagg

SEQ ID NO: 250742 - DNA, 26 bp, Artificial sequence
  SiRNA target sequence
tggcggtgattgtggaaaaattagga

SEQ ID NO: 250743 - DNA, 26 bp, Artificial sequence
  SiRNA target sequence
ggcggtgattgtggaaaaattaggaa

SEQ ID NO: 250744 - DNA, 26 bp, Artificial sequence
  SiRNA target sequence
gcggtgattgtggaaaaattaggaac

SEQ ID NO: 250745 - DNA, 26 bp, Artificial sequence
  SiRNA target sequence
cggtgattgtggaaaaattaggaaca

SEQ ID NO: 250746 - DNA, 26 bp, Artificial sequence
  SiRNA target sequence
ggtgattgtggaaaaattaggaacaa

SEQ ID NO: 250747 - DNA, 26 bp, Artificial sequence
  SiRNA target sequence
gtgattgtggaaaaattaggaacaat

SEQ ID NO: 250748 - DNA, 26 bp, Artificial sequence
  SiRNA target sequence
tgattgtggaaaaattaggaacaatt

SEQ ID NO: 250749 - DNA, 26 bp, Artificial sequence
  SiRNA target sequence
gattgtggaaaaattaggaacaattt

SEQ ID NO: 250750 - DNA, 26 bp, Artificial sequence
  SiRNA target sequence
attgtggaaaaattaggaacaatttc

SEQ ID NO: 250751 - DNA, 26 bp, Artificial sequence
  SiRNA target sequence
ttgtggaaaaattaggaacaatttct

SEQ ID NO: 250752 - DNA, 26 bp, Artificial sequence
  SiRNA target sequence
tgtggaaaaattaggaacaatttctt

SEQ ID NO: 250753 - DNA, 26 bp, Artificial sequence
  SiRNA target sequence
gtggaaaaattaggaacaatttcttt

SEQ ID NO: 250754 - DNA, 26 bp, Artificial sequence
  SiRNA target sequence
tggaaaaattaggaacaatttctttc

SEQ ID NO: 250755 - DNA, 26 bp, Artificial sequence
  SiRNA target sequence
ggaaaaattaggaacaatttctttca

SEQ ID NO: 250756 - DNA, 26 bp, Artificial sequence
  SiRNA target sequence
gaaaaattaggaacaatttctttcat

SEQ ID NO: 250757 - DNA, 26 bp, Artificial sequence
  SiRNA target sequence
aaaaattaggaacaatttctttcatt

SEQ ID NO: 250758 - DNA, 26 bp, Artificial sequence
  SiRNA target sequence
aaaattaggaacaatttctttcattt

SEQ ID NO: 250759 - DNA, 26 bp, Artificial sequence
  SiRNA target sequence
aaattaggaacaatttctttcatttc

SEQ ID NO: 250760 - DNA, 26 bp, Artificial sequence
  SiRNA target sequence
aattaggaacaatttctttcatttca

SEQ ID NO: 250761 - DNA, 26 bp, Artificial sequence
  SiRNA target sequence
attaggaacaatttctttcatttcat

SEQ ID NO: 250762 - DNA, 26 bp, Artificial sequence
  SiRNA target sequence
ttaggaacaatttctttcatttcatc

SEQ ID NO: 250763 - DNA, 26 bp, Artificial sequence
  SiRNA target sequence
taggaacaatttctttcatttcatct

SEQ ID NO: 250764 - DNA, 26 bp, Artificial sequence
  SiRNA target sequence
aggaacaatttctttcatttcatctt

SEQ ID NO: 250765 - DNA, 26 bp, Artificial sequence
  SiRNA target sequence
ggaacaatttctttcatttcatcttc

SEQ ID NO: 250766 - DNA, 26 bp, Artificial sequence
  SiRNA target sequence
gaacaatttctttcatttcatcttct

SEQ ID NO: 250767 - DNA, 26 bp, Artificial sequence
  SiRNA target sequence
aacaatttctttcatttcatcttctg

SEQ ID NO: 250768 - DNA, 26 bp, Artificial sequence
  SiRNA target sequence
acaatttctttcatttcatcttctgt

SEQ ID NO: 250769 - DNA, 26 bp, Artificial sequence
  SiRNA target sequence
caatttctttcatttcatcttctgta

SEQ ID NO: 250770 - DNA, 26 bp, Artificial sequence
  SiRNA target sequence
aatttctttcatttcatcttctgtac

SEQ ID NO: 250771 - DNA, 26 bp, Artificial sequence
  SiRNA target sequence
atttctttcatttcatcttctgtaca

SEQ ID NO: 250772 - DNA, 26 bp, Artificial sequence
  SiRNA target sequence
tttctttcatttcatcttctgtacaa

SEQ ID NO: 250773 - DNA, 26 bp, Artificial sequence
  SiRNA target sequence
ttctttcatttcatcttctgtacaag

SEQ ID NO: 250774 - DNA, 26 bp, Artificial sequence
  SiRNA target sequence
tctttcatttcatcttctgtacaagc

SEQ ID NO: 250775 - DNA, 26 bp, Artificial sequence
  SiRNA target sequence
ctttcatttcatcttctgtacaagca

SEQ ID NO: 250776 - DNA, 26 bp, Artificial sequence
  SiRNA target sequence
tttcatttcatcttctgtacaagcat

SEQ ID NO: 250777 - DNA, 26 bp, Artificial sequence
  SiRNA target sequence
ttcatttcatcttctgtacaagcatg

SEQ ID NO: 250778 - DNA, 26 bp, Artificial sequence
  SiRNA target sequence
tcatttcatcttctgtacaagcatga

SEQ ID NO: 250779 - DNA, 26 bp, Artificial sequence
  SiRNA target sequence
catttcatcttctgtacaagcatgat

SEQ ID NO: 250780 - DNA, 26 bp, Artificial sequence
  SiRNA target sequence
atttcatcttctgtacaagcatgatt

SEQ ID NO: 250781 - DNA, 26 bp, Artificial sequence
  SiRNA target sequence
tttcatcttctgtacaagcatgattg

SEQ ID NO: 250782 - DNA, 26 bp, Artificial sequence
  SiRNA target sequence
ttcatcttctgtacaagcatgattgg

SEQ ID NO: 250783 - DNA, 26 bp, Artificial sequence
  SiRNA target sequence
tcatcttctgtacaagcatgattggc

SEQ ID NO: 250784 - DNA, 26 bp, Artificial sequence
  SiRNA target sequence
catcttctgtacaagcatgattggct

SEQ ID NO: 250785 - DNA, 26 bp, Artificial sequence
  SiRNA target sequence
atcttctgtacaagcatgattggcta

SEQ ID NO: 250786 - DNA, 26 bp, Artificial sequence
  SiRNA target sequence
tcttctgtacaagcatgattggctaa

SEQ ID NO: 250787 - DNA, 26 bp, Artificial sequence
  SiRNA target sequence
cttctgtacaagcatgattggctaac

SEQ ID NO: 250788 - DNA, 26 bp, Artificial sequence
  SiRNA target sequence
ttctgtacaagcatgattggctaacg

SEQ ID NO: 250789 - DNA, 26 bp, Artificial sequence
  SiRNA target sequence
tctgtacaagcatgattggctaacgc

SEQ ID NO: 250790 - DNA, 26 bp, Artificial sequence
  SiRNA target sequence
ctgtacaagcatgattggctaacgca

SEQ ID NO: 250791 - DNA, 26 bp, Artificial sequence
  SiRNA target sequence
tgtacaagcatgattggctaacgcat

SEQ ID NO: 250792 - DNA, 26 bp, Artificial sequence
  SiRNA target sequence
gtacaagcatgattggctaacgcata

SEQ ID NO: 250793 - DNA, 26 bp, Artificial sequence
  SiRNA target sequence
tacaagcatgattggctaacgcatat

SEQ ID NO: 250794 - DNA, 26 bp, Artificial sequence
  SiRNA target sequence
acaagcatgattggctaacgcatata

SEQ ID NO: 250795 - DNA, 26 bp, Artificial sequence
  SiRNA target sequence
caagcatgattggctaacgcatataa

SEQ ID NO: 250796 - DNA, 26 bp, Artificial sequence
  SiRNA target sequence
aagcatgattggctaacgcatataaa

SEQ ID NO: 250797 - DNA, 26 bp, Artificial sequence
  SiRNA target sequence
agcatgattggctaacgcatataaag

SEQ ID NO: 250798 - DNA, 26 bp, Artificial sequence
  SiRNA target sequence
gcatgattggctaacgcatataaagc

SEQ ID NO: 250799 - DNA, 26 bp, Artificial sequence
  SiRNA target sequence
catgattggctaacgcatataaagca

SEQ ID NO: 250800 - DNA, 26 bp, Artificial sequence
  SiRNA target sequence
atgattggctaacgcatataaagcaa

SEQ ID NO: 250801 - DNA, 26 bp, Artificial sequence
  SiRNA target sequence
tgattggctaacgcatataaagcaaa

SEQ ID NO: 250802 - DNA, 26 bp, Artificial sequence
  SiRNA target sequence
gattggctaacgcatataaagcaaaa

SEQ ID NO: 250803 - DNA, 26 bp, Artificial sequence
  SiRNA target sequence
attggctaacgcatataaagcaaaac

SEQ ID NO: 250804 - DNA, 26 bp, Artificial sequence
  SiRNA target sequence
ttggctaacgcatataaagcaaaacc

SEQ ID NO: 250805 - DNA, 26 bp, Artificial sequence
  SiRNA target sequence
tggctaacgcatataaagcaaaacca

SEQ ID NO: 250806 - DNA, 26 bp, Artificial sequence
  SiRNA target sequence
ggctaacgcatataaagcaaaaccaa

SEQ ID NO: 250807 - DNA, 26 bp, Artificial sequence
  SiRNA target sequence
gctaacgcatataaagcaaaaccaac

SEQ ID NO: 250808 - DNA, 26 bp, Artificial sequence
  SiRNA target sequence
ctaacgcatataaagcaaaaccaact

SEQ ID NO: 250809 - DNA, 26 bp, Artificial sequence
  SiRNA target sequence
taacgcatataaagcaaaaccaacta

SEQ ID NO: 250810 - DNA, 26 bp, Artificial sequence
  SiRNA target sequence
aacgcatataaagcaaaaccaactac

SEQ ID NO: 250811 - DNA, 26 bp, Artificial sequence
  SiRNA target sequence
acgcatataaagcaaaaccaactact

SEQ ID NO: 250812 - DNA, 26 bp, Artificial sequence
  SiRNA target sequence
cgcatataaagcaaaaccaactacta

SEQ ID NO: 250813 - DNA, 26 bp, Artificial sequence
  SiRNA target sequence
gcatataaagcaaaaccaactactag

SEQ ID NO: 250814 - DNA, 26 bp, Artificial sequence
  SiRNA target sequence
catataaagcaaaaccaactactaga

SEQ ID NO: 250815 - DNA, 26 bp, Artificial sequence
  SiRNA target sequence
atataaagcaaaaccaactactagag

SEQ ID NO: 250816 - DNA, 26 bp, Artificial sequence
  SiRNA target sequence
tataaagcaaaaccaactactagagt

SEQ ID NO: 250817 - DNA, 26 bp, Artificial sequence
  SiRNA target sequence
ataaagcaaaaccaactactagagta

SEQ ID NO: 250818 - DNA, 26 bp, Artificial sequence
  SiRNA target sequence
taaagcaaaaccaactactagagtac

SEQ ID NO: 250819 - DNA, 26 bp, Artificial sequence
  SiRNA target sequence
aaagcaaaaccaactactagagtact

SEQ ID NO: 250820 - DNA, 26 bp, Artificial sequence
  SiRNA target sequence
aagcaaaaccaactactagagtactc

SEQ ID NO: 250821 - DNA, 26 bp, Artificial sequence
  SiRNA target sequence
agcaaaaccaactactagagtactcc

SEQ ID NO: 250822 - DNA, 26 bp, Artificial sequence
  SiRNA target sequence
gcaaaaccaactactagagtactcca

SEQ ID NO: 250823 - DNA, 26 bp, Artificial sequence
  SiRNA target sequence
caaaaccaactactagagtactccac

SEQ ID NO: 250824 - DNA, 26 bp, Artificial sequence
  SiRNA target sequence
aaaaccaactactagagtactccaca

SEQ ID NO: 250825 - DNA, 26 bp, Artificial sequence
  SiRNA target sequence
aaaccaactactagagtactccacaa

SEQ ID NO: 250826 - DNA, 26 bp, Artificial sequence
  SiRNA target sequence
aaccaactactagagtactccacaac

SEQ ID NO: 250827 - DNA, 26 bp, Artificial sequence
  SiRNA target sequence
accaactactagagtactccacaact

SEQ ID NO: 250828 - DNA, 26 bp, Artificial sequence
  SiRNA target sequence
ccaactactagagtactccacaactc

SEQ ID NO: 250829 - DNA, 26 bp, Artificial sequence
  SiRNA target sequence
caactactagagtactccacaactcc

SEQ ID NO: 250830 - DNA, 26 bp, Artificial sequence
  SiRNA target sequence
aactactagagtactccacaactccg

SEQ ID NO: 250831 - DNA, 26 bp, Artificial sequence
  SiRNA target sequence
actactagagtactccacaactccga

SEQ ID NO: 250832 - DNA, 26 bp, Artificial sequence
  SiRNA target sequence
ctactagagtactccacaactccgat

SEQ ID NO: 250833 - DNA, 26 bp, Artificial sequence
  SiRNA target sequence
tactagagtactccacaactccgata

SEQ ID NO: 250834 - DNA, 26 bp, Artificial sequence
  SiRNA target sequence
actagagtactccacaactccgataa

SEQ ID NO: 250835 - DNA, 26 bp, Artificial sequence
  SiRNA target sequence
ctagagtactccacaactccgataag

SEQ ID NO: 250836 - DNA, 26 bp, Artificial sequence
  SiRNA target sequence
tagagtactccacaactccgataaga

SEQ ID NO: 250837 - DNA, 26 bp, Artificial sequence
  SiRNA target sequence
agagtactccacaactccgataagat

SEQ ID NO: 250838 - DNA, 26 bp, Artificial sequence
  SiRNA target sequence
gagtactccacaactccgataagatg

SEQ ID NO: 250839 - DNA, 26 bp, Artificial sequence
  SiRNA target sequence
agtactccacaactccgataagatgt

SEQ ID NO: 250840 - DNA, 26 bp, Artificial sequence
  SiRNA target sequence
gtactccacaactccgataagatgta

SEQ ID NO: 250841 - DNA, 26 bp, Artificial sequence
  SiRNA target sequence
tactccacaactccgataagatgtaa

SEQ ID NO: 250842 - DNA, 26 bp, Artificial sequence
  SiRNA target sequence
actccacaactccgataagatgtaac

SEQ ID NO: 250843 - DNA, 26 bp, Artificial sequence
  SiRNA target sequence
ctccacaactccgataagatgtaaca

SEQ ID NO: 250844 - DNA, 26 bp, Artificial sequence
  SiRNA target sequence
tccacaactccgataagatgtaacat

SEQ ID NO: 250845 - DNA, 26 bp, Artificial sequence
  SiRNA target sequence
ccacaactccgataagatgtaacata

SEQ ID NO: 250846 - DNA, 26 bp, Artificial sequence
  SiRNA target sequence
cacaactccgataagatgtaacataa

SEQ ID NO: 250847 - DNA, 26 bp, Artificial sequence
  SiRNA target sequence
acaactccgataagatgtaacataaa

SEQ ID NO: 250848 - DNA, 26 bp, Artificial sequence
  SiRNA target sequence
caactccgataagatgtaacataaag

SEQ ID NO: 250849 - DNA, 26 bp, Artificial sequence
  SiRNA target sequence
aactccgataagatgtaacataaagt

SEQ ID NO: 250850 - DNA, 26 bp, Artificial sequence
  SiRNA target sequence
actccgataagatgtaacataaagta

SEQ ID NO: 250851 - DNA, 26 bp, Artificial sequence
  SiRNA target sequence
ctccgataagatgtaacataaagtac

SEQ ID NO: 250852 - DNA, 26 bp, Artificial sequence
  SiRNA target sequence
tccgataagatgtaacataaagtact

SEQ ID NO: 250853 - DNA, 26 bp, Artificial sequence
  SiRNA target sequence
ccgataagatgtaacataaagtactt

SEQ ID NO: 250854 - DNA, 26 bp, Artificial sequence
  SiRNA target sequence
cgataagatgtaacataaagtactta

SEQ ID NO: 250855 - DNA, 26 bp, Artificial sequence
  SiRNA target sequence
gataagatgtaacataaagtacttat

SEQ ID NO: 250856 - DNA, 26 bp, Artificial sequence
  SiRNA target sequence
ataagatgtaacataaagtacttatc

SEQ ID NO: 250857 - DNA, 26 bp, Artificial sequence
  SiRNA target sequence
taagatgtaacataaagtacttatcc

SEQ ID NO: 250858 - DNA, 26 bp, Artificial sequence
  SiRNA target sequence
aagatgtaacataaagtacttatcca

SEQ ID NO: 250859 - DNA, 26 bp, Artificial sequence
  SiRNA target sequence
agatgtaacataaagtacttatccac

SEQ ID NO: 250860 - DNA, 26 bp, Artificial sequence
  SiRNA target sequence
gatgtaacataaagtacttatccact

SEQ ID NO: 250861 - DNA, 26 bp, Artificial sequence
  SiRNA target sequence
atgtaacataaagtacttatccactc

SEQ ID NO: 250862 - DNA, 26 bp, Artificial sequence
  SiRNA target sequence
tgtaacataaagtacttatccactca

SEQ ID NO: 250863 - DNA, 26 bp, Artificial sequence
  SiRNA target sequence
gtaacataaagtacttatccactcac

SEQ ID NO: 250864 - DNA, 26 bp, Artificial sequence
  SiRNA target sequence
taacataaagtacttatccactcact

SEQ ID NO: 250865 - DNA, 26 bp, Artificial sequence
  SiRNA target sequence
aacataaagtacttatccactcactg

SEQ ID NO: 250866 - DNA, 26 bp, Artificial sequence
  SiRNA target sequence
acataaagtacttatccactcactgt

SEQ ID NO: 250867 - DNA, 26 bp, Artificial sequence
  SiRNA target sequence
cataaagtacttatccactcactgta

SEQ ID NO: 250868 - DNA, 26 bp, Artificial sequence
  SiRNA target sequence
ataaagtacttatccactcactgtac

SEQ ID NO: 250869 - DNA, 26 bp, Artificial sequence
  SiRNA target sequence
taaagtacttatccactcactgtaca

SEQ ID NO: 250870 - DNA, 26 bp, Artificial sequence
  SiRNA target sequence
aaagtacttatccactcactgtacat

SEQ ID NO: 250871 - DNA, 26 bp, Artificial sequence
  SiRNA target sequence
aagtacttatccactcactgtacata

SEQ ID NO: 250872 - DNA, 26 bp, Artificial sequence
  SiRNA target sequence
agtacttatccactcactgtacatat

SEQ ID NO: 250873 - DNA, 26 bp, Artificial sequence
  SiRNA target sequence
gtacttatccactcactgtacatata

SEQ ID NO: 250874 - DNA, 26 bp, Artificial sequence
  SiRNA target sequence
tacttatccactcactgtacatatat

SEQ ID NO: 250875 - DNA, 26 bp, Artificial sequence
  SiRNA target sequence
acttatccactcactgtacatatata

SEQ ID NO: 250876 - DNA, 26 bp, Artificial sequence
  SiRNA target sequence
cttatccactcactgtacatatataa

SEQ ID NO: 250877 - DNA, 26 bp, Artificial sequence
  SiRNA target sequence
ttatccactcactgtacatatataaa

SEQ ID NO: 250878 - DNA, 26 bp, Artificial sequence
  SiRNA target sequence
tatccactcactgtacatatataaaa

SEQ ID NO: 250879 - DNA, 26 bp, Artificial sequence
  SiRNA target sequence
atccactcactgtacatatataaaaa

SEQ ID NO: 250880 - DNA, 26 bp, Artificial sequence
  SiRNA target sequence
tccactcactgtacatatataaaaaa

SEQ ID NO: 250881 - DNA, 26 bp, Artificial sequence
  SiRNA target sequence
ccactcactgtacatatataaaaaag

SEQ ID NO: 250882 - DNA, 26 bp, Artificial sequence
  SiRNA target sequence
cactcactgtacatatataaaaaagg

SEQ ID NO: 250883 - DNA, 26 bp, Artificial sequence
  SiRNA target sequence
actcactgtacatatataaaaaagga

SEQ ID NO: 250884 - DNA, 26 bp, Artificial sequence
  SiRNA target sequence
ctcactgtacatatataaaaaaggag

SEQ ID NO: 250885 - DNA, 26 bp, Artificial sequence
  SiRNA target sequence
tcactgtacatatataaaaaaggaga

SEQ ID NO: 250886 - DNA, 26 bp, Artificial sequence
  SiRNA target sequence
cactgtacatatataaaaaaggagat

SEQ ID NO: 250887 - DNA, 26 bp, Artificial sequence
  SiRNA target sequence
actgtacatatataaaaaaggagata

SEQ ID NO: 250888 - DNA, 26 bp, Artificial sequence
  SiRNA target sequence
ctgtacatatataaaaaaggagataa

SEQ ID NO: 250889 - DNA, 26 bp, Artificial sequence
  SiRNA target sequence
tgtacatatataaaaaaggagataag

SEQ ID NO: 250890 - DNA, 26 bp, Artificial sequence
  SiRNA target sequence
gtacatatataaaaaaggagataagc

SEQ ID NO: 250891 - DNA, 26 bp, Artificial sequence
  SiRNA target sequence
tacatatataaaaaaggagataagcc

SEQ ID NO: 250892 - DNA, 26 bp, Artificial sequence
  SiRNA target sequence
acatatataaaaaaggagataagccc

SEQ ID NO: 250893 - DNA, 26 bp, Artificial sequence
  SiRNA target sequence
catatataaaaaaggagataagccca

SEQ ID NO: 250894 - DNA, 26 bp, Artificial sequence
  SiRNA target sequence
atatataaaaaaggagataagcccat

SEQ ID NO: 250895 - DNA, 26 bp, Artificial sequence
  SiRNA target sequence
tatataaaaaaggagataagcccatc

SEQ ID NO: 250896 - DNA, 26 bp, Artificial sequence
  SiRNA target sequence
atataaaaaaggagataagcccatca

SEQ ID NO: 250897 - DNA, 26 bp, Artificial sequence
  SiRNA target sequence
tataaaaaaggagataagcccatcaa

SEQ ID NO: 250898 - DNA, 26 bp, Artificial sequence
  SiRNA target sequence
ataaaaaaggagataagcccatcaag

SEQ ID NO: 250899 - DNA, 26 bp, Artificial sequence
  SiRNA target sequence
taaaaaaggagataagcccatcaagc

SEQ ID NO: 250900 - DNA, 26 bp, Artificial sequence
  SiRNA target sequence
aaaaaaggagataagcccatcaagct

SEQ ID NO: 250901 - DNA, 26 bp, Artificial sequence
  SiRNA target sequence
aaaaaggagataagcccatcaagctt

SEQ ID NO: 250902 - DNA, 26 bp, Artificial sequence
  SiRNA target sequence
aaaaggagataagcccatcaagcttc

SEQ ID NO: 250903 - DNA, 26 bp, Artificial sequence
  SiRNA target sequence
aaaggagataagcccatcaagcttct

SEQ ID NO: 250904 - DNA, 26 bp, Artificial sequence
  SiRNA target sequence
aaggagataagcccatcaagcttcta

SEQ ID NO: 250905 - DNA, 26 bp, Artificial sequence
  SiRNA target sequence
aggagataagcccatcaagcttctaa

SEQ ID NO: 250906 - DNA, 26 bp, Artificial sequence
  SiRNA target sequence
ggagataagcccatcaagcttctaac

SEQ ID NO: 250907 - DNA, 26 bp, Artificial sequence
  SiRNA target sequence
gagataagcccatcaagcttctaact

SEQ ID NO: 250908 - DNA, 26 bp, Artificial sequence
  SiRNA target sequence
agataagcccatcaagcttctaactg

SEQ ID NO: 250909 - DNA, 26 bp, Artificial sequence
  SiRNA target sequence
gataagcccatcaagcttctaactga

SEQ ID NO: 250910 - DNA, 26 bp, Artificial sequence
  SiRNA target sequence
ataagcccatcaagcttctaactgac

SEQ ID NO: 250911 - DNA, 26 bp, Artificial sequence
  SiRNA target sequence
taagcccatcaagcttctaactgaca

SEQ ID NO: 250912 - DNA, 26 bp, Artificial sequence
  SiRNA target sequence
aagcccatcaagcttctaactgacat

SEQ ID NO: 250913 - DNA, 26 bp, Artificial sequence
  SiRNA target sequence
agcccatcaagcttctaactgacatc

SEQ ID NO: 250914 - DNA, 26 bp, Artificial sequence
  SiRNA target sequence
gcccatcaagcttctaactgacatct

SEQ ID NO: 250915 - DNA, 26 bp, Artificial sequence
  SiRNA target sequence
cccatcaagcttctaactgacatctt

SEQ ID NO: 250916 - DNA, 26 bp, Artificial sequence
  SiRNA target sequence
ccatcaagcttctaactgacatctta

SEQ ID NO: 250917 - DNA, 26 bp, Artificial sequence
  SiRNA target sequence
catcaagcttctaactgacatcttac

SEQ ID NO: 250918 - DNA, 26 bp, Artificial sequence
  SiRNA target sequence
atcaagcttctaactgacatcttacc

SEQ ID NO: 250919 - DNA, 26 bp, Artificial sequence
  SiRNA target sequence
tcaagcttctaactgacatcttacca

SEQ ID NO: 250920 - DNA, 26 bp, Artificial sequence
  SiRNA target sequence
caagcttctaactgacatcttaccat

SEQ ID NO: 250921 - DNA, 26 bp, Artificial sequence
  SiRNA target sequence
aagcttctaactgacatcttaccatc

SEQ ID NO: 250922 - DNA, 26 bp, Artificial sequence
  SiRNA target sequence
agcttctaactgacatcttaccatca

SEQ ID NO: 250923 - DNA, 26 bp, Artificial sequence
  SiRNA target sequence
gcttctaactgacatcttaccatcac

SEQ ID NO: 250924 - DNA, 26 bp, Artificial sequence
  SiRNA target sequence
cttctaactgacatcttaccatcaca

SEQ ID NO: 250925 - DNA, 26 bp, Artificial sequence
  SiRNA target sequence
ttctaactgacatcttaccatcacaa

SEQ ID NO: 250926 - DNA, 26 bp, Artificial sequence
  SiRNA target sequence
tctaactgacatcttaccatcacaaa

SEQ ID NO: 250927 - DNA, 26 bp, Artificial sequence
  SiRNA target sequence
ctaactgacatcttaccatcacaaaa

SEQ ID NO: 250928 - DNA, 26 bp, Artificial sequence
  SiRNA target sequence
taactgacatcttaccatcacaaaaa

SEQ ID NO: 250929 - DNA, 26 bp, Artificial sequence
  SiRNA target sequence
aactgacatcttaccatcacaaaaaa

SEQ ID NO: 250930 - DNA, 26 bp, Artificial sequence
  SiRNA target sequence
actgacatcttaccatcacaaaaaat

SEQ ID NO: 250931 - DNA, 26 bp, Artificial sequence
  SiRNA target sequence
ctgacatcttaccatcacaaaaaata

SEQ ID NO: 250932 - DNA, 26 bp, Artificial sequence
  SiRNA target sequence
tgacatcttaccatcacaaaaaatat

SEQ ID NO: 250933 - DNA, 26 bp, Artificial sequence
  SiRNA target sequence
gacatcttaccatcacaaaaaatatc

SEQ ID NO: 250934 - DNA, 26 bp, Artificial sequence
  SiRNA target sequence
acatcttaccatcacaaaaaatatct

SEQ ID NO: 250935 - DNA, 26 bp, Artificial sequence
  SiRNA target sequence
catcttaccatcacaaaaaatatcta

SEQ ID NO: 250936 - DNA, 26 bp, Artificial sequence
  SiRNA target sequence
atcttaccatcacaaaaaatatctag

SEQ ID NO: 250937 - DNA, 26 bp, Artificial sequence
  SiRNA target sequence
tcttaccatcacaaaaaatatctagt

SEQ ID NO: 250938 - DNA, 26 bp, Artificial sequence
  SiRNA target sequence
cttaccatcacaaaaaatatctagtg

SEQ ID NO: 250939 - DNA, 26 bp, Artificial sequence
  SiRNA target sequence
ttaccatcacaaaaaatatctagtgc

SEQ ID NO: 250940 - DNA, 26 bp, Artificial sequence
  SiRNA target sequence
taccatcacaaaaaatatctagtgcc

SEQ ID NO: 250941 - DNA, 26 bp, Artificial sequence
  SiRNA target sequence
accatcacaaaaaatatctagtgccc

SEQ ID NO: 250942 - DNA, 26 bp, Artificial sequence
  SiRNA target sequence
ccatcacaaaaaatatctagtgccca

SEQ ID NO: 250943 - DNA, 26 bp, Artificial sequence
  SiRNA target sequence
catcacaaaaaatatctagtgcccat

SEQ ID NO: 250944 - DNA, 26 bp, Artificial sequence
  SiRNA target sequence
atcacaaaaaatatctagtgcccatt

SEQ ID NO: 250945 - DNA, 26 bp, Artificial sequence
  SiRNA target sequence
tcacaaaaaatatctagtgcccattg

SEQ ID NO: 250946 - DNA, 26 bp, Artificial sequence
  SiRNA target sequence
cacaaaaaatatctagtgcccattgt

SEQ ID NO: 250947 - DNA, 26 bp, Artificial sequence
  SiRNA target sequence
acaaaaaatatctagtgcccattgtg

SEQ ID NO: 250948 - DNA, 26 bp, Artificial sequence
  SiRNA target sequence
caaaaaatatctagtgcccattgtga

SEQ ID NO: 250949 - DNA, 26 bp, Artificial sequence
  SiRNA target sequence
aaaaaatatctagtgcccattgtgat

SEQ ID NO: 250950 - DNA, 26 bp, Artificial sequence
  SiRNA target sequence
aaaaatatctagtgcccattgtgatc

SEQ ID NO: 250951 - DNA, 26 bp, Artificial sequence
  SiRNA target sequence
aaaatatctagtgcccattgtgatcc

SEQ ID NO: 250952 - DNA, 26 bp, Artificial sequence
  SiRNA target sequence
aaatatctagtgcccattgtgatcct

SEQ ID NO: 250953 - DNA, 26 bp, Artificial sequence
  SiRNA target sequence
aatatctagtgcccattgtgatcctt

SEQ ID NO: 250954 - DNA, 26 bp, Artificial sequence
  SiRNA target sequence
atatctagtgcccattgtgatccttt

SEQ ID NO: 250955 - DNA, 26 bp, Artificial sequence
  SiRNA target sequence
tatctagtgcccattgtgatcctttt

SEQ ID NO: 250956 - DNA, 26 bp, Artificial sequence
  SiRNA target sequence
atctagtgcccattgtgatccttttt

SEQ ID NO: 250957 - DNA, 26 bp, Artificial sequence
  SiRNA target sequence
tctagtgcccattgtgatcctttttg

SEQ ID NO: 250958 - DNA, 26 bp, Artificial sequence
  SiRNA target sequence
ctagtgcccattgtgatcctttttgg

SEQ ID NO: 250959 - DNA, 26 bp, Artificial sequence
  SiRNA target sequence
tagtgcccattgtgatcctttttgga

SEQ ID NO: 250960 - DNA, 26 bp, Artificial sequence
  SiRNA target sequence
agtgcccattgtgatcctttttggat

SEQ ID NO: 250961 - DNA, 26 bp, Artificial sequence
  SiRNA target sequence
gtgcccattgtgatcctttttggatt

SEQ ID NO: 250962 - DNA, 26 bp, Artificial sequence
  SiRNA target sequence
tgcccattgtgatcctttttggattt

SEQ ID NO: 250963 - DNA, 26 bp, Artificial sequence
  SiRNA target sequence
gcccattgtgatcctttttggatttt

SEQ ID NO: 250964 - DNA, 26 bp, Artificial sequence
  SiRNA target sequence
cccattgtgatcctttttggatttta

SEQ ID NO: 250965 - DNA, 26 bp, Artificial sequence
  SiRNA target sequence
ccattgtgatcctttttggattttat

SEQ ID NO: 250966 - DNA, 26 bp, Artificial sequence
  SiRNA target sequence
cattgtgatcctttttggattttata

SEQ ID NO: 250967 - DNA, 26 bp, Artificial sequence
  SiRNA target sequence
attgtgatcctttttggattttatat

SEQ ID NO: 250968 - DNA, 26 bp, Artificial sequence
  SiRNA target sequence
ttgtgatcctttttggattttatatt

SEQ ID NO: 250969 - DNA, 26 bp, Artificial sequence
  SiRNA target sequence
tgtgatcctttttggattttatattc

SEQ ID NO: 250970 - DNA, 26 bp, Artificial sequence
  SiRNA target sequence
gtgatcctttttggattttatattca

SEQ ID NO: 250971 - DNA, 26 bp, Artificial sequence
  SiRNA target sequence
tgatcctttttggattttatattcaa

SEQ ID NO: 250972 - DNA, 26 bp, Artificial sequence
  SiRNA target sequence
gatcctttttggattttatattcaaa

SEQ ID NO: 250973 - DNA, 26 bp, Artificial sequence
  SiRNA target sequence
atcctttttggattttatattcaaat

SEQ ID NO: 250974 - DNA, 26 bp, Artificial sequence
  SiRNA target sequence
tcctttttggattttatattcaaatg

SEQ ID NO: 250975 - DNA, 26 bp, Artificial sequence
  SiRNA target sequence
cctttttggattttatattcaaatgg

SEQ ID NO: 250976 - DNA, 26 bp, Artificial sequence
  SiRNA target sequence
ctttttggattttatattcaaatgga

SEQ ID NO: 250977 - DNA, 26 bp, Artificial sequence
  SiRNA target sequence
tttttggattttatattcaaatggaa

SEQ ID NO: 250978 - DNA, 26 bp, Artificial sequence
  SiRNA target sequence
ttttggattttatattcaaatggaat

SEQ ID NO: 250979 - DNA, 26 bp, Artificial sequence
  SiRNA target sequence
tttggattttatattcaaatggaatt

SEQ ID NO: 250980 - DNA, 26 bp, Artificial sequence
  SiRNA target sequence
ttggattttatattcaaatggaatta

SEQ ID NO: 250981 - DNA, 26 bp, Artificial sequence
  SiRNA target sequence
tggattttatattcaaatggaattaa

SEQ ID NO: 250982 - DNA, 26 bp, Artificial sequence
  SiRNA target sequence
ggattttatattcaaatggaattaaa

SEQ ID NO: 250983 - DNA, 26 bp, Artificial sequence
  SiRNA target sequence
gattttatattcaaatggaattaaaa

SEQ ID NO: 250984 - DNA, 26 bp, Artificial sequence
  SiRNA target sequence
attttatattcaaatggaattaaaag

SEQ ID NO: 250985 - DNA, 26 bp, Artificial sequence
  SiRNA target sequence
ttttatattcaaatggaattaaaaga

SEQ ID NO: 250986 - DNA, 26 bp, Artificial sequence
  SiRNA target sequence
tttatattcaaatggaattaaaagag

SEQ ID NO: 250987 - DNA, 26 bp, Artificial sequence
  SiRNA target sequence
ttatattcaaatggaattaaaagaga

SEQ ID NO: 250988 - DNA, 26 bp, Artificial sequence
  SiRNA target sequence
tatattcaaatggaattaaaagagaa

SEQ ID NO: 250989 - DNA, 26 bp, Artificial sequence
  SiRNA target sequence
atattcaaatggaattaaaagagaac

SEQ ID NO: 250990 - DNA, 26 bp, Artificial sequence
  SiRNA target sequence
tattcaaatggaattaaaagagaacc

SEQ ID NO: 250991 - DNA, 26 bp, Artificial sequence
  SiRNA target sequence
attcaaatggaattaaaagagaacca

SEQ ID NO: 250992 - DNA, 26 bp, Artificial sequence
  SiRNA target sequence
ttcaaatggaattaaaagagaaccaa

SEQ ID NO: 250993 - DNA, 26 bp, Artificial sequence
  SiRNA target sequence
tcaaatggaattaaaagagaaccaat

SEQ ID NO: 250994 - DNA, 26 bp, Artificial sequence
  SiRNA target sequence
caaatggaattaaaagagaaccaatt

SEQ ID NO: 250995 - DNA, 26 bp, Artificial sequence
  SiRNA target sequence
aaatggaattaaaagagaaccaatta

SEQ ID NO: 250996 - DNA, 26 bp, Artificial sequence
  SiRNA target sequence
aatggaattaaaagagaaccaattag

SEQ ID NO: 250997 - DNA, 26 bp, Artificial sequence
  SiRNA target sequence
atggaattaaaagagaaccaattaga

SEQ ID NO: 250998 - DNA, 26 bp, Artificial sequence
  SiRNA target sequence
tggaattaaaagagaaccaattagaa

SEQ ID NO: 250999 - DNA, 26 bp, Artificial sequence
  SiRNA target sequence
ggaattaaaagagaaccaattagaaa

SEQ ID NO: 251000 - DNA, 26 bp, Artificial sequence
  SiRNA target sequence
gaattaaaagagaaccaattagaaaa

SEQ ID NO: 251001 - DNA, 26 bp, Artificial sequence
  SiRNA target sequence
aattaaaagagaaccaattagaaaaa

SEQ ID NO: 251002 - DNA, 26 bp, Artificial sequence
  SiRNA target sequence
attaaaagagaaccaattagaaaaaa

SEQ ID NO: 251003 - DNA, 26 bp, Artificial sequence
  SiRNA target sequence
ttaaaagagaaccaattagaaaaaaa

SEQ ID NO: 251004 - DNA, 26 bp, Artificial sequence
  SiRNA target sequence
taaaagagaaccaattagaaaaaaaa

SEQ ID NO: 251005 - DNA, 26 bp, Artificial sequence
  SiRNA target sequence
aaaagagaaccaattagaaaaaaaat

SEQ ID NO: 251006 - DNA, 26 bp, Artificial sequence
  SiRNA target sequence
aaagagaaccaattagaaaaaaaatg

SEQ ID NO: 251007 - DNA, 26 bp, Artificial sequence
  SiRNA target sequence
aagagaaccaattagaaaaaaaatgc

SEQ ID NO: 251008 - DNA, 26 bp, Artificial sequence
  SiRNA target sequence
agagaaccaattagaaaaaaaatgcc

SEQ ID NO: 251009 - DNA, 26 bp, Artificial sequence
  SiRNA target sequence
gagaaccaattagaaaaaaaatgcca

SEQ ID NO: 251010 - DNA, 26 bp, Artificial sequence
  SiRNA target sequence
agaaccaattagaaaaaaaatgccaa

SEQ ID NO: 251011 - DNA, 26 bp, Artificial sequence
  SiRNA target sequence
gaaccaattagaaaaaaaatgccaat

SEQ ID NO: 251012 - DNA, 26 bp, Artificial sequence
  SiRNA target sequence
aaccaattagaaaaaaaatgccaata

SEQ ID NO: 251013 - DNA, 26 bp, Artificial sequence
  SiRNA target sequence
accaattagaaaaaaaatgccaataa

SEQ ID NO: 251014 - DNA, 26 bp, Artificial sequence
  SiRNA target sequence
ccaattagaaaaaaaatgccaataaa

SEQ ID NO: 251015 - DNA, 26 bp, Artificial sequence
  SiRNA target sequence
caattagaaaaaaaatgccaataaaa

SEQ ID NO: 251016 - DNA, 26 bp, Artificial sequence
  SiRNA target sequence
aattagaaaaaaaatgccaataaaac

SEQ ID NO: 251017 - DNA, 26 bp, Artificial sequence
  SiRNA target sequence
attagaaaaaaaatgccaataaaacc

SEQ ID NO: 251018 - DNA, 26 bp, Artificial sequence
  SiRNA target sequence
ttagaaaaaaaatgccaataaaacca

SEQ ID NO: 251019 - DNA, 26 bp, Artificial sequence
  SiRNA target sequence
tagaaaaaaaatgccaataaaaccaa

SEQ ID NO: 251020 - DNA, 26 bp, Artificial sequence
  SiRNA target sequence
agaaaaaaaatgccaataaaaccaaa

SEQ ID NO: 251021 - DNA, 26 bp, Artificial sequence
  SiRNA target sequence
gaaaaaaaatgccaataaaaccaaaa

SEQ ID NO: 251022 - DNA, 26 bp, Artificial sequence
  SiRNA target sequence
aaaaaaaatgccaataaaaccaaaaa

SEQ ID NO: 251023 - DNA, 26 bp, Artificial sequence
  SiRNA target sequence
aaaaaaatgccaataaaaccaaaaat

SEQ ID NO: 251024 - DNA, 26 bp, Artificial sequence
  SiRNA target sequence
aaaaaatgccaataaaaccaaaaata

SEQ ID NO: 251025 - DNA, 26 bp, Artificial sequence
  SiRNA target sequence
aaaaatgccaataaaaccaaaaataa

SEQ ID NO: 251026 - DNA, 26 bp, Artificial sequence
  SiRNA target sequence
aaaatgccaataaaaccaaaaataat

SEQ ID NO: 251027 - DNA, 26 bp, Artificial sequence
  SiRNA target sequence
aaatgccaataaaaccaaaaataata

SEQ ID NO: 251028 - DNA, 26 bp, Artificial sequence
  SiRNA target sequence
aatgccaataaaaccaaaaataataa

SEQ ID NO: 251029 - DNA, 26 bp, Artificial sequence
  SiRNA target sequence
atgccaataaaaccaaaaataataaa

SEQ ID NO: 251030 - DNA, 26 bp, Artificial sequence
  SiRNA target sequence
tgccaataaaaccaaaaataataaaa

SEQ ID NO: 251031 - DNA, 26 bp, Artificial sequence
  SiRNA target sequence
gccaataaaaccaaaaataataaaat

SEQ ID NO: 251032 - DNA, 26 bp, Artificial sequence
  SiRNA target sequence
ccaataaaaccaaaaataataaaatt

SEQ ID NO: 251033 - DNA, 26 bp, Artificial sequence
  SiRNA target sequence
caataaaaccaaaaataataaaattc

SEQ ID NO: 251034 - DNA, 26 bp, Artificial sequence
  SiRNA target sequence
aataaaaccaaaaataataaaattca

SEQ ID NO: 251035 - DNA, 26 bp, Artificial sequence
  SiRNA target sequence
ataaaaccaaaaataataaaattcac

SEQ ID NO: 251036 - DNA, 26 bp, Artificial sequence
  SiRNA target sequence
taaaaccaaaaataataaaattcaca

SEQ ID NO: 251037 - DNA, 26 bp, Artificial sequence
  SiRNA target sequence
aaaaccaaaaataataaaattcacaa

SEQ ID NO: 251038 - DNA, 26 bp, Artificial sequence
  SiRNA target sequence
aaaccaaaaataataaaattcacaat

SEQ ID NO: 251039 - DNA, 26 bp, Artificial sequence
  SiRNA target sequence
aaccaaaaataataaaattcacaata

SEQ ID NO: 251040 - DNA, 26 bp, Artificial sequence
  SiRNA target sequence
accaaaaataataaaattcacaatac

SEQ ID NO: 251041 - DNA, 26 bp, Artificial sequence
  SiRNA target sequence
ccaaaaataataaaattcacaatact

SEQ ID NO: 251042 - DNA, 26 bp, Artificial sequence
  SiRNA target sequence
caaaaataataaaattcacaatacta

SEQ ID NO: 251043 - DNA, 26 bp, Artificial sequence
  SiRNA target sequence
aaaaataataaaattcacaatactaa

SEQ ID NO: 251044 - DNA, 26 bp, Artificial sequence
  SiRNA target sequence
aaaataataaaattcacaatactaag

SEQ ID NO: 251045 - DNA, 26 bp, Artificial sequence
  SiRNA target sequence
aaataataaaattcacaatactaaga

SEQ ID NO: 251046 - DNA, 26 bp, Artificial sequence
  SiRNA target sequence
aataataaaattcacaatactaagaa

SEQ ID NO: 251047 - DNA, 26 bp, Artificial sequence
  SiRNA target sequence
ataataaaattcacaatactaagaat

SEQ ID NO: 251048 - DNA, 26 bp, Artificial sequence
  SiRNA target sequence
taataaaattcacaatactaagaata

SEQ ID NO: 251049 - DNA, 26 bp, Artificial sequence
  SiRNA target sequence
aataaaattcacaatactaagaatag

SEQ ID NO: 251050 - DNA, 26 bp, Artificial sequence
  SiRNA target sequence
ataaaattcacaatactaagaataga

SEQ ID NO: 251051 - DNA, 26 bp, Artificial sequence
  SiRNA target sequence
taaaattcacaatactaagaatagag

SEQ ID NO: 251052 - DNA, 26 bp, Artificial sequence
  SiRNA target sequence
aaaattcacaatactaagaatagagt

SEQ ID NO: 251053 - DNA, 26 bp, Artificial sequence
  SiRNA target sequence
aaattcacaatactaagaatagagta

SEQ ID NO: 251054 - DNA, 26 bp, Artificial sequence
  SiRNA target sequence
aattcacaatactaagaatagagtac

SEQ ID NO: 251055 - DNA, 26 bp, Artificial sequence
  SiRNA target sequence
attcacaatactaagaatagagtaca

SEQ ID NO: 251056 - DNA, 26 bp, Artificial sequence
  SiRNA target sequence
ttcacaatactaagaatagagtacac

SEQ ID NO: 251057 - DNA, 26 bp, Artificial sequence
  SiRNA target sequence
tcacaatactaagaatagagtacaca

SEQ ID NO: 251058 - DNA, 26 bp, Artificial sequence
  SiRNA target sequence
cacaatactaagaatagagtacacat

SEQ ID NO: 251059 - DNA, 26 bp, Artificial sequence
  SiRNA target sequence
acaatactaagaatagagtacacatt

SEQ ID NO: 251060 - DNA, 26 bp, Artificial sequence
  SiRNA target sequence
caatactaagaatagagtacacattt

SEQ ID NO: 251061 - DNA, 26 bp, Artificial sequence
  SiRNA target sequence
aatactaagaatagagtacacattta

SEQ ID NO: 251062 - DNA, 26 bp, Artificial sequence
  SiRNA target sequence
atactaagaatagagtacacatttaa

SEQ ID NO: 251063 - DNA, 26 bp, Artificial sequence
  SiRNA target sequence
tactaagaatagagtacacatttaaa

SEQ ID NO: 251064 - DNA, 26 bp, Artificial sequence
  SiRNA target sequence
actaagaatagagtacacatttaaag

SEQ ID NO: 251065 - DNA, 26 bp, Artificial sequence
  SiRNA target sequence
ctaagaatagagtacacatttaaagc

SEQ ID NO: 251066 - DNA, 26 bp, Artificial sequence
  SiRNA target sequence
taagaatagagtacacatttaaagcc

SEQ ID NO: 251067 - DNA, 26 bp, Artificial sequence
  SiRNA target sequence
aagaatagagtacacatttaaagcct

SEQ ID NO: 251068 - DNA, 26 bp, Artificial sequence
  SiRNA target sequence
agaatagagtacacatttaaagcctt

SEQ ID NO: 251069 - DNA, 26 bp, Artificial sequence
  SiRNA target sequence
gaatagagtacacatttaaagccttt

SEQ ID NO: 251070 - DNA, 26 bp, Artificial sequence
  SiRNA target sequence
aatagagtacacatttaaagcctttt

SEQ ID NO: 251071 - DNA, 26 bp, Artificial sequence
  SiRNA target sequence
atagagtacacatttaaagccttttg

SEQ ID NO: 251072 - DNA, 26 bp, Artificial sequence
  SiRNA target sequence
tagagtacacatttaaagccttttgg

SEQ ID NO: 251073 - DNA, 26 bp, Artificial sequence
  SiRNA target sequence
agagtacacatttaaagccttttgga

SEQ ID NO: 251074 - DNA, 26 bp, Artificial sequence
  SiRNA target sequence
gagtacacatttaaagccttttggac

SEQ ID NO: 251075 - DNA, 26 bp, Artificial sequence
  SiRNA target sequence
agtacacatttaaagccttttggaca

SEQ ID NO: 251076 - DNA, 26 bp, Artificial sequence
  SiRNA target sequence
gtacacatttaaagccttttggacat

SEQ ID NO: 251077 - DNA, 26 bp, Artificial sequence
  SiRNA target sequence
tacacatttaaagccttttggacata

SEQ ID NO: 251078 - DNA, 26 bp, Artificial sequence
  SiRNA target sequence
acacatttaaagccttttggacatat

SEQ ID NO: 251079 - DNA, 26 bp, Artificial sequence
  SiRNA target sequence
cacatttaaagccttttggacatatg

SEQ ID NO: 251080 - DNA, 26 bp, Artificial sequence
  SiRNA target sequence
acatttaaagccttttggacatatga

SEQ ID NO: 251081 - DNA, 26 bp, Artificial sequence
  SiRNA target sequence
catttaaagccttttggacatatgac

SEQ ID NO: 251082 - DNA, 26 bp, Artificial sequence
  SiRNA target sequence
atttaaagccttttggacatatgaca

SEQ ID NO: 251083 - DNA, 26 bp, Artificial sequence
  SiRNA target sequence
tttaaagccttttggacatatgacat

SEQ ID NO: 251084 - DNA, 26 bp, Artificial sequence
  SiRNA target sequence
ttaaagccttttggacatatgacatc

SEQ ID NO: 251085 - DNA, 26 bp, Artificial sequence
  SiRNA target sequence
taaagccttttggacatatgacatca

SEQ ID NO: 251086 - DNA, 26 bp, Artificial sequence
  SiRNA target sequence
aaagccttttggacatatgacatcat

SEQ ID NO: 251087 - DNA, 26 bp, Artificial sequence
  SiRNA target sequence
aagccttttggacatatgacatcata

SEQ ID NO: 251088 - DNA, 26 bp, Artificial sequence
  SiRNA target sequence
agccttttggacatatgacatcataa

SEQ ID NO: 251089 - DNA, 26 bp, Artificial sequence
  SiRNA target sequence
gccttttggacatatgacatcataag

SEQ ID NO: 251090 - DNA, 26 bp, Artificial sequence
  SiRNA target sequence
ccttttggacatatgacatcataaga

SEQ ID NO: 251091 - DNA, 26 bp, Artificial sequence
  SiRNA target sequence
cttttggacatatgacatcataagac

SEQ ID NO: 251092 - DNA, 26 bp, Artificial sequence
  SiRNA target sequence
ttttggacatatgacatcataagaca

SEQ ID NO: 251093 - DNA, 26 bp, Artificial sequence
  SiRNA target sequence
tttggacatatgacatcataagacat

SEQ ID NO: 251094 - DNA, 26 bp, Artificial sequence
  SiRNA target sequence
ttggacatatgacatcataagacata

SEQ ID NO: 251095 - DNA, 26 bp, Artificial sequence
  SiRNA target sequence
tggacatatgacatcataagacatat

SEQ ID NO: 251096 - DNA, 26 bp, Artificial sequence
  SiRNA target sequence
ggacatatgacatcataagacatata

SEQ ID NO: 251097 - DNA, 26 bp, Artificial sequence
  SiRNA target sequence
gacatatgacatcataagacatataa

SEQ ID NO: 251098 - DNA, 26 bp, Artificial sequence
  SiRNA target sequence
acatatgacatcataagacatataat

SEQ ID NO: 251099 - DNA, 26 bp, Artificial sequence
  SiRNA target sequence
catatgacatcataagacatataatt

SEQ ID NO: 251100 - DNA, 26 bp, Artificial sequence
  SiRNA target sequence
atatgacatcataagacatataattg

SEQ ID NO: 251101 - DNA, 26 bp, Artificial sequence
  SiRNA target sequence
tatgacatcataagacatataattgg

SEQ ID NO: 251102 - DNA, 26 bp, Artificial sequence
  SiRNA target sequence
atgacatcataagacatataattggc

SEQ ID NO: 251103 - DNA, 26 bp, Artificial sequence
  SiRNA target sequence
tgacatcataagacatataattggca

SEQ ID NO: 251104 - DNA, 26 bp, Artificial sequence
  SiRNA target sequence
gacatcataagacatataattggcag

SEQ ID NO: 251105 - DNA, 26 bp, Artificial sequence
  SiRNA target sequence
acatcataagacatataattggcagt

SEQ ID NO: 251106 - DNA, 26 bp, Artificial sequence
  SiRNA target sequence
catcataagacatataattggcagtg

SEQ ID NO: 251107 - DNA, 26 bp, Artificial sequence
  SiRNA target sequence
atcataagacatataattggcagtga

SEQ ID NO: 251108 - DNA, 26 bp, Artificial sequence
  SiRNA target sequence
tcataagacatataattggcagtgaa

SEQ ID NO: 251109 - DNA, 26 bp, Artificial sequence
  SiRNA target sequence
cataagacatataattggcagtgaaa

SEQ ID NO: 251110 - DNA, 26 bp, Artificial sequence
  SiRNA target sequence
ataagacatataattggcagtgaaaa

SEQ ID NO: 251111 - DNA, 26 bp, Artificial sequence
  SiRNA target sequence
taagacatataattggcagtgaaaag

SEQ ID NO: 251112 - DNA, 26 bp, Artificial sequence
  SiRNA target sequence
aagacatataattggcagtgaaaaga

SEQ ID NO: 251113 - DNA, 26 bp, Artificial sequence
  SiRNA target sequence
agacatataattggcagtgaaaagaa

SEQ ID NO: 251114 - DNA, 26 bp, Artificial sequence
  SiRNA target sequence
gacatataattggcagtgaaaagaaa

SEQ ID NO: 251115 - DNA, 26 bp, Artificial sequence
  SiRNA target sequence
acatataattggcagtgaaaagaaaa

SEQ ID NO: 251116 - DNA, 26 bp, Artificial sequence
  SiRNA target sequence
catataattggcagtgaaaagaaaag

SEQ ID NO: 251117 - DNA, 26 bp, Artificial sequence
  SiRNA target sequence
atataattggcagtgaaaagaaaagc

SEQ ID NO: 251118 - DNA, 26 bp, Artificial sequence
  SiRNA target sequence
tataattggcagtgaaaagaaaagct

SEQ ID NO: 251119 - DNA, 26 bp, Artificial sequence
  SiRNA target sequence
ataattggcagtgaaaagaaaagctt

SEQ ID NO: 251120 - DNA, 26 bp, Artificial sequence
  SiRNA target sequence
taattggcagtgaaaagaaaagcttt

SEQ ID NO: 251121 - DNA, 26 bp, Artificial sequence
  SiRNA target sequence
aattggcagtgaaaagaaaagcttta

SEQ ID NO: 251122 - DNA, 26 bp, Artificial sequence
  SiRNA target sequence
attggcagtgaaaagaaaagctttat

SEQ ID NO: 251123 - DNA, 26 bp, Artificial sequence
  SiRNA target sequence
ttggcagtgaaaagaaaagctttatg

SEQ ID NO: 251124 - DNA, 26 bp, Artificial sequence
  SiRNA target sequence
tggcagtgaaaagaaaagctttatgt

SEQ ID NO: 251125 - DNA, 26 bp, Artificial sequence
  SiRNA target sequence
ggcagtgaaaagaaaagctttatgta

SEQ ID NO: 251126 - DNA, 26 bp, Artificial sequence
  SiRNA target sequence
gcagtgaaaagaaaagctttatgtag

SEQ ID NO: 251127 - DNA, 26 bp, Artificial sequence
  SiRNA target sequence
cagtgaaaagaaaagctttatgtagt

SEQ ID NO: 251128 - DNA, 26 bp, Artificial sequence
  SiRNA target sequence
agtgaaaagaaaagctttatgtagta

SEQ ID NO: 251129 - DNA, 26 bp, Artificial sequence
  SiRNA target sequence
gtgaaaagaaaagctttatgtagtac

SEQ ID NO: 251130 - DNA, 26 bp, Artificial sequence
  SiRNA target sequence
tgaaaagaaaagctttatgtagtaca

SEQ ID NO: 251131 - DNA, 26 bp, Artificial sequence
  SiRNA target sequence
gaaaagaaaagctttatgtagtacag

SEQ ID NO: 251132 - DNA, 26 bp, Artificial sequence
  SiRNA target sequence
aaaagaaaagctttatgtagtacagt

SEQ ID NO: 251133 - DNA, 26 bp, Artificial sequence
  SiRNA target sequence
aaagaaaagctttatgtagtacagtg

SEQ ID NO: 251134 - DNA, 26 bp, Artificial sequence
  SiRNA target sequence
aagaaaagctttatgtagtacagtga

SEQ ID NO: 251135 - DNA, 26 bp, Artificial sequence
  SiRNA target sequence
agaaaagctttatgtagtacagtgac

SEQ ID NO: 251136 - DNA, 26 bp, Artificial sequence
  SiRNA target sequence
gaaaagctttatgtagtacagtgacg

SEQ ID NO: 251137 - DNA, 26 bp, Artificial sequence
  SiRNA target sequence
aaaagctttatgtagtacagtgacga

SEQ ID NO: 251138 - DNA, 26 bp, Artificial sequence
  SiRNA target sequence
aaagctttatgtagtacagtgacgaa

SEQ ID NO: 251139 - DNA, 26 bp, Artificial sequence
  SiRNA target sequence
aagctttatgtagtacagtgacgaag

SEQ ID NO: 251140 - DNA, 26 bp, Artificial sequence
  SiRNA target sequence
agctttatgtagtacagtgacgaagg

SEQ ID NO: 251141 - DNA, 26 bp, Artificial sequence
  SiRNA target sequence
gctttatgtagtacagtgacgaagga

SEQ ID NO: 251142 - DNA, 26 bp, Artificial sequence
  SiRNA target sequence
ctttatgtagtacagtgacgaaggaa

SEQ ID NO: 251143 - DNA, 26 bp, Artificial sequence
  SiRNA target sequence
tttatgtagtacagtgacgaaggaat

SEQ ID NO: 251144 - DNA, 26 bp, Artificial sequence
  SiRNA target sequence
ttatgtagtacagtgacgaaggaatt

SEQ ID NO: 251145 - DNA, 26 bp, Artificial sequence
  SiRNA target sequence
tatgtagtacagtgacgaaggaattt

SEQ ID NO: 251146 - DNA, 26 bp, Artificial sequence
  SiRNA target sequence
atgtagtacagtgacgaaggaatttg

SEQ ID NO: 251147 - DNA, 26 bp, Artificial sequence
  SiRNA target sequence
tgtagtacagtgacgaaggaatttgt

SEQ ID NO: 251148 - DNA, 26 bp, Artificial sequence
  SiRNA target sequence
gtagtacagtgacgaaggaatttgtt

SEQ ID NO: 251149 - DNA, 26 bp, Artificial sequence
  SiRNA target sequence
tagtacagtgacgaaggaatttgttt

SEQ ID NO: 251150 - DNA, 26 bp, Artificial sequence
  SiRNA target sequence
agtacagtgacgaaggaatttgtttt

SEQ ID NO: 251151 - DNA, 26 bp, Artificial sequence
  SiRNA target sequence
gtacagtgacgaaggaatttgttttg

SEQ ID NO: 251152 - DNA, 26 bp, Artificial sequence
  SiRNA target sequence
tacagtgacgaaggaatttgttttgt

SEQ ID NO: 251153 - DNA, 26 bp, Artificial sequence
  SiRNA target sequence
acagtgacgaaggaatttgttttgtc

SEQ ID NO: 251154 - DNA, 26 bp, Artificial sequence
  SiRNA target sequence
cagtgacgaaggaatttgttttgtca

SEQ ID NO: 251155 - DNA, 26 bp, Artificial sequence
  SiRNA target sequence
agtgacgaaggaatttgttttgtcat

SEQ ID NO: 251156 - DNA, 26 bp, Artificial sequence
  SiRNA target sequence
gtgacgaaggaatttgttttgtcata

SEQ ID NO: 251157 - DNA, 26 bp, Artificial sequence
  SiRNA target sequence
tgacgaaggaatttgttttgtcataa

SEQ ID NO: 251158 - DNA, 26 bp, Artificial sequence
  SiRNA target sequence
gacgaaggaatttgttttgtcataat

SEQ ID NO: 251159 - DNA, 26 bp, Artificial sequence
  SiRNA target sequence
acgaaggaatttgttttgtcataatc

SEQ ID NO: 251160 - DNA, 26 bp, Artificial sequence
  SiRNA target sequence
cgaaggaatttgttttgtcataatca

SEQ ID NO: 251161 - DNA, 26 bp, Artificial sequence
  SiRNA target sequence
gaaggaatttgttttgtcataatcac

SEQ ID NO: 251162 - DNA, 26 bp, Artificial sequence
  SiRNA target sequence
aaggaatttgttttgtcataatcacg

SEQ ID NO: 251163 - DNA, 26 bp, Artificial sequence
  SiRNA target sequence
aggaatttgttttgtcataatcacga

SEQ ID NO: 251164 - DNA, 26 bp, Artificial sequence
  SiRNA target sequence
ggaatttgttttgtcataatcacgat

SEQ ID NO: 251165 - DNA, 26 bp, Artificial sequence
  SiRNA target sequence
gaatttgttttgtcataatcacgatt

SEQ ID NO: 251166 - DNA, 26 bp, Artificial sequence
  SiRNA target sequence
aatttgttttgtcataatcacgattt

SEQ ID NO: 251167 - DNA, 26 bp, Artificial sequence
  SiRNA target sequence
atttgttttgtcataatcacgatttc

SEQ ID NO: 251168 - DNA, 26 bp, Artificial sequence
  SiRNA target sequence
tttgttttgtcataatcacgatttct

SEQ ID NO: 251169 - DNA, 26 bp, Artificial sequence
  SiRNA target sequence
ttgttttgtcataatcacgatttctc

SEQ ID NO: 251170 - DNA, 26 bp, Artificial sequence
  SiRNA target sequence
tgttttgtcataatcacgatttctct

SEQ ID NO: 251171 - DNA, 26 bp, Artificial sequence
  SiRNA target sequence
gttttgtcataatcacgatttctctg

SEQ ID NO: 251172 - DNA, 26 bp, Artificial sequence
  SiRNA target sequence
ttttgtcataatcacgatttctctgt

SEQ ID NO: 251173 - DNA, 26 bp, Artificial sequence
  SiRNA target sequence
tttgtcataatcacgatttctctgta

SEQ ID NO: 251174 - DNA, 26 bp, Artificial sequence
  SiRNA target sequence
ttgtcataatcacgatttctctgtaa

SEQ ID NO: 251175 - DNA, 26 bp, Artificial sequence
  SiRNA target sequence
tgtcataatcacgatttctctgtaaa

SEQ ID NO: 251176 - DNA, 26 bp, Artificial sequence
  SiRNA target sequence
gtcataatcacgatttctctgtaaaa

SEQ ID NO: 251177 - DNA, 26 bp, Artificial sequence
  SiRNA target sequence
tcataatcacgatttctctgtaaaat

SEQ ID NO: 251178 - DNA, 26 bp, Artificial sequence
  SiRNA target sequence
cataatcacgatttctctgtaaaatt

SEQ ID NO: 251179 - DNA, 26 bp, Artificial sequence
  SiRNA target sequence
ataatcacgatttctctgtaaaattc

SEQ ID NO: 251180 - DNA, 26 bp, Artificial sequence
  SiRNA target sequence
taatcacgatttctctgtaaaattcc

SEQ ID NO: 251181 - DNA, 26 bp, Artificial sequence
  SiRNA target sequence
aatcacgatttctctgtaaaattcca

SEQ ID NO: 251182 - DNA, 26 bp, Artificial sequence
  SiRNA target sequence
atcacgatttctctgtaaaattccaa

SEQ ID NO: 251183 - DNA, 26 bp, Artificial sequence
  SiRNA target sequence
tcacgatttctctgtaaaattccaat

SEQ ID NO: 251184 - DNA, 26 bp, Artificial sequence
  SiRNA target sequence
cacgatttctctgtaaaattccaata

SEQ ID NO: 251185 - DNA, 26 bp, Artificial sequence
  SiRNA target sequence
acgatttctctgtaaaattccaataa

SEQ ID NO: 251186 - DNA, 26 bp, Artificial sequence
  SiRNA target sequence
cgatttctctgtaaaattccaataat

SEQ ID NO: 251187 - DNA, 26 bp, Artificial sequence
  SiRNA target sequence
gatttctctgtaaaattccaataatg

SEQ ID NO: 251188 - DNA, 26 bp, Artificial sequence
  SiRNA target sequence
atttctctgtaaaattccaataatgt

SEQ ID NO: 251189 - DNA, 26 bp, Artificial sequence
  SiRNA target sequence
tttctctgtaaaattccaataatgtg

SEQ ID NO: 251190 - DNA, 26 bp, Artificial sequence
  SiRNA target sequence
ttctctgtaaaattccaataatgtgt

SEQ ID NO: 251191 - DNA, 26 bp, Artificial sequence
  SiRNA target sequence
tctctgtaaaattccaataatgtgtt

SEQ ID NO: 251192 - DNA, 26 bp, Artificial sequence
  SiRNA target sequence
ctctgtaaaattccaataatgtgtta

SEQ ID NO: 251193 - DNA, 26 bp, Artificial sequence
  SiRNA target sequence
tctgtaaaattccaataatgtgttaa

SEQ ID NO: 251194 - DNA, 26 bp, Artificial sequence
  SiRNA target sequence
ctgtaaaattccaataatgtgttaat

SEQ ID NO: 251195 - DNA, 26 bp, Artificial sequence
  SiRNA target sequence
tgtaaaattccaataatgtgttaatc

SEQ ID NO: 251196 - DNA, 26 bp, Artificial sequence
  SiRNA target sequence
gtaaaattccaataatgtgttaatca

SEQ ID NO: 251197 - DNA, 26 bp, Artificial sequence
  SiRNA target sequence
taaaattccaataatgtgttaatcac

SEQ ID NO: 251198 - DNA, 26 bp, Artificial sequence
  SiRNA target sequence
aaaattccaataatgtgttaatcaca

SEQ ID NO: 251199 - DNA, 26 bp, Artificial sequence
  SiRNA target sequence
aaattccaataatgtgttaatcacac

SEQ ID NO: 251200 - DNA, 26 bp, Artificial sequence
  SiRNA target sequence
aattccaataatgtgttaatcacaca

SEQ ID NO: 251201 - DNA, 26 bp, Artificial sequence
  SiRNA target sequence
attccaataatgtgttaatcacacat

SEQ ID NO: 251202 - DNA, 26 bp, Artificial sequence
  SiRNA target sequence
ttccaataatgtgttaatcacacatg

SEQ ID NO: 251203 - DNA, 26 bp, Artificial sequence
  SiRNA target sequence
tccaataatgtgttaatcacacatgc

SEQ ID NO: 251204 - DNA, 26 bp, Artificial sequence
  SiRNA target sequence
ccaataatgtgttaatcacacatgcc

SEQ ID NO: 251205 - DNA, 26 bp, Artificial sequence
  SiRNA target sequence
caataatgtgttaatcacacatgcca

SEQ ID NO: 251206 - DNA, 26 bp, Artificial sequence
  SiRNA target sequence
aataatgtgttaatcacacatgccat

SEQ ID NO: 251207 - DNA, 26 bp, Artificial sequence
  SiRNA target sequence
ataatgtgttaatcacacatgccatt

SEQ ID NO: 251208 - DNA, 26 bp, Artificial sequence
  SiRNA target sequence
taatgtgttaatcacacatgccatta

SEQ ID NO: 251209 - DNA, 26 bp, Artificial sequence
  SiRNA target sequence
aatgtgttaatcacacatgccattaa

SEQ ID NO: 251210 - DNA, 26 bp, Artificial sequence
  SiRNA target sequence
atgtgttaatcacacatgccattaaa

SEQ ID NO: 251211 - DNA, 26 bp, Artificial sequence
  SiRNA target sequence
tgtgttaatcacacatgccattaaaa

SEQ ID NO: 251212 - DNA, 26 bp, Artificial sequence
  SiRNA target sequence
gtgttaatcacacatgccattaaaaa

SEQ ID NO: 251213 - DNA, 26 bp, Artificial sequence
  SiRNA target sequence
tgttaatcacacatgccattaaaaat

SEQ ID NO: 251214 - DNA, 26 bp, Artificial sequence
  SiRNA target sequence
gttaatcacacatgccattaaaaatg

SEQ ID NO: 251215 - DNA, 26 bp, Artificial sequence
  SiRNA target sequence
ttaatcacacatgccattaaaaatgt

SEQ ID NO: 251216 - DNA, 26 bp, Artificial sequence
  SiRNA target sequence
taatcacacatgccattaaaaatgta

SEQ ID NO: 251217 - DNA, 26 bp, Artificial sequence
  SiRNA target sequence
aatcacacatgccattaaaaatgtaa

SEQ ID NO: 251218 - DNA, 26 bp, Artificial sequence
  SiRNA target sequence
atcacacatgccattaaaaatgtaag

SEQ ID NO: 251219 - DNA, 26 bp, Artificial sequence
  SiRNA target sequence
tcacacatgccattaaaaatgtaagt

SEQ ID NO: 251220 - DNA, 26 bp, Artificial sequence
  SiRNA target sequence
cacacatgccattaaaaatgtaagtg

SEQ ID NO: 251221 - DNA, 26 bp, Artificial sequence
  SiRNA target sequence
acacatgccattaaaaatgtaagtga

SEQ ID NO: 251222 - DNA, 26 bp, Artificial sequence
  SiRNA target sequence
cacatgccattaaaaatgtaagtgac

SEQ ID NO: 251223 - DNA, 26 bp, Artificial sequence
  SiRNA target sequence
acatgccattaaaaatgtaagtgaca

SEQ ID NO: 251224 - DNA, 26 bp, Artificial sequence
  SiRNA target sequence
catgccattaaaaatgtaagtgacaa

SEQ ID NO: 251225 - DNA, 26 bp, Artificial sequence
  SiRNA target sequence
atgccattaaaaatgtaagtgacaat

SEQ ID NO: 251226 - DNA, 26 bp, Artificial sequence
  SiRNA target sequence
tgccattaaaaatgtaagtgacaata

SEQ ID NO: 251227 - DNA, 26 bp, Artificial sequence
  SiRNA target sequence
gccattaaaaatgtaagtgacaataa

SEQ ID NO: 251228 - DNA, 26 bp, Artificial sequence
  SiRNA target sequence
ccattaaaaatgtaagtgacaataat

SEQ ID NO: 251229 - DNA, 26 bp, Artificial sequence
  SiRNA target sequence
cattaaaaatgtaagtgacaataata

SEQ ID NO: 251230 - DNA, 26 bp, Artificial sequence
  SiRNA target sequence
attaaaaatgtaagtgacaataatat

SEQ ID NO: 251231 - DNA, 26 bp, Artificial sequence
  SiRNA target sequence
ttaaaaatgtaagtgacaataatatt

SEQ ID NO: 251232 - DNA, 26 bp, Artificial sequence
  SiRNA target sequence
taaaaatgtaagtgacaataatattt

SEQ ID NO: 251233 - DNA, 26 bp, Artificial sequence
  SiRNA target sequence
aaaaatgtaagtgacaataatatttt

SEQ ID NO: 251234 - DNA, 26 bp, Artificial sequence
  SiRNA target sequence
aaaatgtaagtgacaataatattttt

SEQ ID NO: 251235 - DNA, 26 bp, Artificial sequence
  SiRNA target sequence
aaatgtaagtgacaataatattttta

SEQ ID NO: 251236 - DNA, 26 bp, Artificial sequence
  SiRNA target sequence
aatgtaagtgacaataatatttttac

SEQ ID NO: 251237 - DNA, 26 bp, Artificial sequence
  SiRNA target sequence
atgtaagtgacaataatatttttact

SEQ ID NO: 251238 - DNA, 26 bp, Artificial sequence
  SiRNA target sequence
tgtaagtgacaataatatttttactt

SEQ ID NO: 251239 - DNA, 26 bp, Artificial sequence
  SiRNA target sequence
gtaagtgacaataatatttttacttt

SEQ ID NO: 251240 - DNA, 26 bp, Artificial sequence
  SiRNA target sequence
taagtgacaataatatttttactttt

SEQ ID NO: 251241 - DNA, 26 bp, Artificial sequence
  SiRNA target sequence
aagtgacaataatatttttacttttg

SEQ ID NO: 251242 - DNA, 26 bp, Artificial sequence
  SiRNA target sequence
agtgacaataatatttttacttttgg

SEQ ID NO: 251243 - DNA, 26 bp, Artificial sequence
  SiRNA target sequence
gtgacaataatatttttacttttggg

SEQ ID NO: 251244 - DNA, 26 bp, Artificial sequence
  SiRNA target sequence
tgacaataatatttttacttttggga

SEQ ID NO: 251245 - DNA, 26 bp, Artificial sequence
  SiRNA target sequence
gacaataatatttttacttttgggaa

SEQ ID NO: 251246 - DNA, 26 bp, Artificial sequence
  SiRNA target sequence
acaataatatttttacttttgggaat

SEQ ID NO: 251247 - DNA, 26 bp, Artificial sequence
  SiRNA target sequence
caataatatttttacttttgggaatt

SEQ ID NO: 251248 - DNA, 26 bp, Artificial sequence
  SiRNA target sequence
aataatatttttacttttgggaattt

SEQ ID NO: 251249 - DNA, 26 bp, Artificial sequence
  SiRNA target sequence
ataatatttttacttttgggaatttt

SEQ ID NO: 251250 - DNA, 26 bp, Artificial sequence
  SiRNA target sequence
taatatttttacttttgggaattttt

SEQ ID NO: 251251 - DNA, 26 bp, Artificial sequence
  SiRNA target sequence
aatatttttacttttgggaatttttt

SEQ ID NO: 251252 - DNA, 26 bp, Artificial sequence
  SiRNA target sequence
atatttttacttttgggaattttttt

SEQ ID NO: 251253 - DNA, 26 bp, Artificial sequence
  SiRNA target sequence
tatttttacttttgggaatttttttg

SEQ ID NO: 251254 - DNA, 26 bp, Artificial sequence
  SiRNA target sequence
atttttacttttgggaatttttttgt

SEQ ID NO: 251255 - DNA, 26 bp, Artificial sequence
  SiRNA target sequence
tttttacttttgggaatttttttgtc

SEQ ID NO: 251256 - DNA, 26 bp, Artificial sequence
  SiRNA target sequence
ttttacttttgggaatttttttgtct

SEQ ID NO: 251257 - DNA, 26 bp, Artificial sequence
  SiRNA target sequence
tttacttttgggaatttttttgtctt

SEQ ID NO: 251258 - DNA, 26 bp, Artificial sequence
  SiRNA target sequence
ttacttttgggaatttttttgtctta

SEQ ID NO: 251259 - DNA, 26 bp, Artificial sequence
  SiRNA target sequence
tacttttgggaatttttttgtcttag

SEQ ID NO: 251260 - DNA, 26 bp, Artificial sequence
  SiRNA target sequence
acttttgggaatttttttgtcttagt

SEQ ID NO: 251261 - DNA, 26 bp, Artificial sequence
  SiRNA target sequence
cttttgggaatttttttgtcttagtc

SEQ ID NO: 251262 - DNA, 26 bp, Artificial sequence
  SiRNA target sequence
ttttgggaatttttttgtcttagtca

SEQ ID NO: 251263 - DNA, 26 bp, Artificial sequence
  SiRNA target sequence
tttgggaatttttttgtcttagtcat

SEQ ID NO: 251264 - DNA, 27 bp, Artificial sequence
  SiRNA target sequence
ttaattaaaatcaacatctatctcaga

SEQ ID NO: 251265 - DNA, 27 bp, Artificial sequence
  SiRNA target sequence
taattaaaatcaacatctatctcagaa

SEQ ID NO: 251266 - DNA, 27 bp, Artificial sequence
  SiRNA target sequence
aattaaaatcaacatctatctcagaat

SEQ ID NO: 251267 - DNA, 27 bp, Artificial sequence
  SiRNA target sequence
attaaaatcaacatctatctcagaatt

SEQ ID NO: 251268 - DNA, 27 bp, Artificial sequence
  SiRNA target sequence
ttaaaatcaacatctatctcagaattt

SEQ ID NO: 251269 - DNA, 27 bp, Artificial sequence
  SiRNA target sequence
taaaatcaacatctatctcagaatttt

SEQ ID NO: 251270 - DNA, 27 bp, Artificial sequence
  SiRNA target sequence
aaaatcaacatctatctcagaattttg

SEQ ID NO: 251271 - DNA, 27 bp, Artificial sequence
  SiRNA target sequence
aaatcaacatctatctcagaattttgt

SEQ ID NO: 251272 - DNA, 27 bp, Artificial sequence
  SiRNA target sequence
aatcaacatctatctcagaattttgtt

SEQ ID NO: 251273 - DNA, 27 bp, Artificial sequence
  SiRNA target sequence
atcaacatctatctcagaattttgttc

SEQ ID NO: 251274 - DNA, 27 bp, Artificial sequence
  SiRNA target sequence
tcaacatctatctcagaattttgttca

SEQ ID NO: 251275 - DNA, 27 bp, Artificial sequence
  SiRNA target sequence
caacatctatctcagaattttgttcaa

SEQ ID NO: 251276 - DNA, 27 bp, Artificial sequence
  SiRNA target sequence
aacatctatctcagaattttgttcaat

SEQ ID NO: 251277 - DNA, 27 bp, Artificial sequence
  SiRNA target sequence
acatctatctcagaattttgttcaatt

SEQ ID NO: 251278 - DNA, 27 bp, Artificial sequence
  SiRNA target sequence
catctatctcagaattttgttcaattg

SEQ ID NO: 251279 - DNA, 27 bp, Artificial sequence
  SiRNA target sequence
atctatctcagaattttgttcaattga

SEQ ID NO: 251280 - DNA, 27 bp, Artificial sequence
  SiRNA target sequence
tctatctcagaattttgttcaattgat

SEQ ID NO: 251281 - DNA, 27 bp, Artificial sequence
  SiRNA target sequence
ctatctcagaattttgttcaattgatt

SEQ ID NO: 251282 - DNA, 27 bp, Artificial sequence
  SiRNA target sequence
tatctcagaattttgttcaattgattc

SEQ ID NO: 251283 - DNA, 27 bp, Artificial sequence
  SiRNA target sequence
atctcagaattttgttcaattgattca

SEQ ID NO: 251284 - DNA, 27 bp, Artificial sequence
  SiRNA target sequence
tctcagaattttgttcaattgattcat

SEQ ID NO: 251285 - DNA, 27 bp, Artificial sequence
  SiRNA target sequence
ctcagaattttgttcaattgattcatt

SEQ ID NO: 251286 - DNA, 27 bp, Artificial sequence
  SiRNA target sequence
tcagaattttgttcaattgattcatta

SEQ ID NO: 251287 - DNA, 27 bp, Artificial sequence
  SiRNA target sequence
cagaattttgttcaattgattcattat

SEQ ID NO: 251288 - DNA, 27 bp, Artificial sequence
  SiRNA target sequence
agaattttgttcaattgattcattata

SEQ ID NO: 251289 - DNA, 27 bp, Artificial sequence
  SiRNA target sequence
gaattttgttcaattgattcattatat

SEQ ID NO: 251290 - DNA, 27 bp, Artificial sequence
  SiRNA target sequence
aattttgttcaattgattcattatatt

SEQ ID NO: 251291 - DNA, 27 bp, Artificial sequence
  SiRNA target sequence
attttgttcaattgattcattatattt

SEQ ID NO: 251292 - DNA, 27 bp, Artificial sequence
  SiRNA target sequence
ttttgttcaattgattcattatatttt

SEQ ID NO: 251293 - DNA, 27 bp, Artificial sequence
  SiRNA target sequence
tttgttcaattgattcattatattttt

SEQ ID NO: 251294 - DNA, 27 bp, Artificial sequence
  SiRNA target sequence
ttgttcaattgattcattatatttttt

SEQ ID NO: 251295 - DNA, 27 bp, Artificial sequence
  SiRNA target sequence
tgttcaattgattcattatatttttta

SEQ ID NO: 251296 - DNA, 27 bp, Artificial sequence
  SiRNA target sequence
gttcaattgattcattatattttttac

SEQ ID NO: 251297 - DNA, 27 bp, Artificial sequence
  SiRNA target sequence
ttcaattgattcattatattttttact

SEQ ID NO: 251298 - DNA, 27 bp, Artificial sequence
  SiRNA target sequence
tcaattgattcattatattttttactt

SEQ ID NO: 251299 - DNA, 27 bp, Artificial sequence
  SiRNA target sequence
caattgattcattatattttttactta

SEQ ID NO: 251300 - DNA, 27 bp, Artificial sequence
  SiRNA target sequence
aattgattcattatattttttacttaa

SEQ ID NO: 251301 - DNA, 27 bp, Artificial sequence
  SiRNA target sequence
attgattcattatattttttacttaaa

SEQ ID NO: 251302 - DNA, 27 bp, Artificial sequence
  SiRNA target sequence
ttgattcattatattttttacttaaat

SEQ ID NO: 251303 - DNA, 27 bp, Artificial sequence
  SiRNA target sequence
tgattcattatattttttacttaaata

SEQ ID NO: 251304 - DNA, 27 bp, Artificial sequence
  SiRNA target sequence
gattcattatattttttacttaaataa

SEQ ID NO: 251305 - DNA, 27 bp, Artificial sequence
  SiRNA target sequence
attcattatattttttacttaaataac

SEQ ID NO: 251306 - DNA, 27 bp, Artificial sequence
  SiRNA target sequence
ttcattatattttttacttaaataaca

SEQ ID NO: 251307 - DNA, 27 bp, Artificial sequence
  SiRNA target sequence
tcattatattttttacttaaataacag

SEQ ID NO: 251308 - DNA, 27 bp, Artificial sequence
  SiRNA target sequence
cattatattttttacttaaataacaga

SEQ ID NO: 251309 - DNA, 27 bp, Artificial sequence
  SiRNA target sequence
attatattttttacttaaataacagac

SEQ ID NO: 251310 - DNA, 27 bp, Artificial sequence
  SiRNA target sequence
ttatattttttacttaaataacagaca

SEQ ID NO: 251311 - DNA, 27 bp, Artificial sequence
  SiRNA target sequence
tatattttttacttaaataacagacac

SEQ ID NO: 251312 - DNA, 27 bp, Artificial sequence
  SiRNA target sequence
atattttttacttaaataacagacact

SEQ ID NO: 251313 - DNA, 27 bp, Artificial sequence
  SiRNA target sequence
tattttttacttaaataacagacactc

SEQ ID NO: 251314 - DNA, 27 bp, Artificial sequence
  SiRNA target sequence
attttttacttaaataacagacactcc

SEQ ID NO: 251315 - DNA, 27 bp, Artificial sequence
  SiRNA target sequence
ttttttacttaaataacagacactcct

SEQ ID NO: 251316 - DNA, 27 bp, Artificial sequence
  SiRNA target sequence
tttttacttaaataacagacactcctg

SEQ ID NO: 251317 - DNA, 27 bp, Artificial sequence
  SiRNA target sequence
ttttacttaaataacagacactcctga

SEQ ID NO: 251318 - DNA, 27 bp, Artificial sequence
  SiRNA target sequence
tttacttaaataacagacactcctgat

SEQ ID NO: 251319 - DNA, 27 bp, Artificial sequence
  SiRNA target sequence
ttacttaaataacagacactcctgatc

SEQ ID NO: 251320 - DNA, 27 bp, Artificial sequence
  SiRNA target sequence
tacttaaataacagacactcctgatcc

SEQ ID NO: 251321 - DNA, 27 bp, Artificial sequence
  SiRNA target sequence
acttaaataacagacactcctgatcca

SEQ ID NO: 251322 - DNA, 27 bp, Artificial sequence
  SiRNA target sequence
cttaaataacagacactcctgatccac

SEQ ID NO: 251323 - DNA, 27 bp, Artificial sequence
  SiRNA target sequence
ttaaataacagacactcctgatccaca

SEQ ID NO: 251324 - DNA, 27 bp, Artificial sequence
  SiRNA target sequence
taaataacagacactcctgatccacaa

SEQ ID NO: 251325 - DNA, 27 bp, Artificial sequence
  SiRNA target sequence
aaataacagacactcctgatccacaaa

SEQ ID NO: 251326 - DNA, 27 bp, Artificial sequence
  SiRNA target sequence
aataacagacactcctgatccacaaaa

SEQ ID NO: 251327 - DNA, 27 bp, Artificial sequence
  SiRNA target sequence
ataacagacactcctgatccacaaaaa

SEQ ID NO: 251328 - DNA, 27 bp, Artificial sequence
  SiRNA target sequence
taacagacactcctgatccacaaaaaa

SEQ ID NO: 251329 - DNA, 27 bp, Artificial sequence
  SiRNA target sequence
aacagacactcctgatccacaaaaaat

SEQ ID NO: 251330 - DNA, 27 bp, Artificial sequence
  SiRNA target sequence
acagacactcctgatccacaaaaaatt

SEQ ID NO: 251331 - DNA, 27 bp, Artificial sequence
  SiRNA target sequence
cagacactcctgatccacaaaaaattt

SEQ ID NO: 251332 - DNA, 27 bp, Artificial sequence
  SiRNA target sequence
agacactcctgatccacaaaaaatttg

SEQ ID NO: 251333 - DNA, 27 bp, Artificial sequence
  SiRNA target sequence
gacactcctgatccacaaaaaatttgc

SEQ ID NO: 251334 - DNA, 27 bp, Artificial sequence
  SiRNA target sequence
acactcctgatccacaaaaaatttgca

SEQ ID NO: 251335 - DNA, 27 bp, Artificial sequence
  SiRNA target sequence
cactcctgatccacaaaaaatttgcaa

SEQ ID NO: 251336 - DNA, 27 bp, Artificial sequence
  SiRNA target sequence
actcctgatccacaaaaaatttgcaaa

SEQ ID NO: 251337 - DNA, 27 bp, Artificial sequence
  SiRNA target sequence
ctcctgatccacaaaaaatttgcaaat

SEQ ID NO: 251338 - DNA, 27 bp, Artificial sequence
  SiRNA target sequence
tcctgatccacaaaaaatttgcaaata

SEQ ID NO: 251339 - DNA, 27 bp, Artificial sequence
  SiRNA target sequence
cctgatccacaaaaaatttgcaaatat

SEQ ID NO: 251340 - DNA, 27 bp, Artificial sequence
  SiRNA target sequence
ctgatccacaaaaaatttgcaaatatt

SEQ ID NO: 251341 - DNA, 27 bp, Artificial sequence
  SiRNA target sequence
tgatccacaaaaaatttgcaaatatta

SEQ ID NO: 251342 - DNA, 27 bp, Artificial sequence
  SiRNA target sequence
gatccacaaaaaatttgcaaatattaa

SEQ ID NO: 251343 - DNA, 27 bp, Artificial sequence
  SiRNA target sequence
atccacaaaaaatttgcaaatattaaa

SEQ ID NO: 251344 - DNA, 27 bp, Artificial sequence
  SiRNA target sequence
tccacaaaaaatttgcaaatattaaaa

SEQ ID NO: 251345 - DNA, 27 bp, Artificial sequence
  SiRNA target sequence
ccacaaaaaatttgcaaatattaaaaa

SEQ ID NO: 251346 - DNA, 27 bp, Artificial sequence
  SiRNA target sequence
cacaaaaaatttgcaaatattaaaaat

SEQ ID NO: 251347 - DNA, 27 bp, Artificial sequence
  SiRNA target sequence
acaaaaaatttgcaaatattaaaaata

SEQ ID NO: 251348 - DNA, 27 bp, Artificial sequence
  SiRNA target sequence
caaaaaatttgcaaatattaaaaatat

SEQ ID NO: 251349 - DNA, 27 bp, Artificial sequence
  SiRNA target sequence
aaaaaatttgcaaatattaaaaatata

SEQ ID NO: 251350 - DNA, 27 bp, Artificial sequence
  SiRNA target sequence
aaaaatttgcaaatattaaaaatataa

SEQ ID NO: 251351 - DNA, 27 bp, Artificial sequence
  SiRNA target sequence
aaaatttgcaaatattaaaaatataaa

SEQ ID NO: 251352 - DNA, 27 bp, Artificial sequence
  SiRNA target sequence
aaatttgcaaatattaaaaatataaaa

SEQ ID NO: 251353 - DNA, 27 bp, Artificial sequence
  SiRNA target sequence
aatttgcaaatattaaaaatataaaag

SEQ ID NO: 251354 - DNA, 27 bp, Artificial sequence
  SiRNA target sequence
atttgcaaatattaaaaatataaaaga

SEQ ID NO: 251355 - DNA, 27 bp, Artificial sequence
  SiRNA target sequence
tttgcaaatattaaaaatataaaagac

SEQ ID NO: 251356 - DNA, 27 bp, Artificial sequence
  SiRNA target sequence
ttgcaaatattaaaaatataaaagaca

SEQ ID NO: 251357 - DNA, 27 bp, Artificial sequence
  SiRNA target sequence
tgcaaatattaaaaatataaaagacac

SEQ ID NO: 251358 - DNA, 27 bp, Artificial sequence
  SiRNA target sequence
gcaaatattaaaaatataaaagacacg

SEQ ID NO: 251359 - DNA, 27 bp, Artificial sequence
  SiRNA target sequence
caaatattaaaaatataaaagacacgt

SEQ ID NO: 251360 - DNA, 27 bp, Artificial sequence
  SiRNA target sequence
aaatattaaaaatataaaagacacgta

SEQ ID NO: 251361 - DNA, 27 bp, Artificial sequence
  SiRNA target sequence
aatattaaaaatataaaagacacgtat

SEQ ID NO: 251362 - DNA, 27 bp, Artificial sequence
  SiRNA target sequence
atattaaaaatataaaagacacgtatg

SEQ ID NO: 251363 - DNA, 27 bp, Artificial sequence
  SiRNA target sequence
tattaaaaatataaaagacacgtatga

SEQ ID NO: 251364 - DNA, 27 bp, Artificial sequence
  SiRNA target sequence
attaaaaatataaaagacacgtatgat

SEQ ID NO: 251365 - DNA, 27 bp, Artificial sequence
  SiRNA target sequence
ttaaaaatataaaagacacgtatgata

SEQ ID NO: 251366 - DNA, 27 bp, Artificial sequence
  SiRNA target sequence
taaaaatataaaagacacgtatgatac

SEQ ID NO: 251367 - DNA, 27 bp, Artificial sequence
  SiRNA target sequence
aaaaatataaaagacacgtatgatact

SEQ ID NO: 251368 - DNA, 27 bp, Artificial sequence
  SiRNA target sequence
aaaatataaaagacacgtatgatactt

SEQ ID NO: 251369 - DNA, 27 bp, Artificial sequence
  SiRNA target sequence
aaatataaaagacacgtatgatacttg

SEQ ID NO: 251370 - DNA, 27 bp, Artificial sequence
  SiRNA target sequence
aatataaaagacacgtatgatacttgt

SEQ ID NO: 251371 - DNA, 27 bp, Artificial sequence
  SiRNA target sequence
atataaaagacacgtatgatacttgtc

SEQ ID NO: 251372 - DNA, 27 bp, Artificial sequence
  SiRNA target sequence
tataaaagacacgtatgatacttgtct

SEQ ID NO: 251373 - DNA, 27 bp, Artificial sequence
  SiRNA target sequence
ataaaagacacgtatgatacttgtcta

SEQ ID NO: 251374 - DNA, 27 bp, Artificial sequence
  SiRNA target sequence
taaaagacacgtatgatacttgtctaa

SEQ ID NO: 251375 - DNA, 27 bp, Artificial sequence
  SiRNA target sequence
aaaagacacgtatgatacttgtctaat

SEQ ID NO: 251376 - DNA, 27 bp, Artificial sequence
  SiRNA target sequence
aaagacacgtatgatacttgtctaata

SEQ ID NO: 251377 - DNA, 27 bp, Artificial sequence
  SiRNA target sequence
aagacacgtatgatacttgtctaatat

SEQ ID NO: 251378 - DNA, 27 bp, Artificial sequence
  SiRNA target sequence
agacacgtatgatacttgtctaatatc

SEQ ID NO: 251379 - DNA, 27 bp, Artificial sequence
  SiRNA target sequence
gacacgtatgatacttgtctaatatct

SEQ ID NO: 251380 - DNA, 27 bp, Artificial sequence
  SiRNA target sequence
acacgtatgatacttgtctaatatctg

SEQ ID NO: 251381 - DNA, 27 bp, Artificial sequence
  SiRNA target sequence
cacgtatgatacttgtctaatatctgg

SEQ ID NO: 251382 - DNA, 27 bp, Artificial sequence
  SiRNA target sequence
acgtatgatacttgtctaatatctgga

SEQ ID NO: 251383 - DNA, 27 bp, Artificial sequence
  SiRNA target sequence
cgtatgatacttgtctaatatctggaa

SEQ ID NO: 251384 - DNA, 27 bp, Artificial sequence
  SiRNA target sequence
gtatgatacttgtctaatatctggaat

SEQ ID NO: 251385 - DNA, 27 bp, Artificial sequence
  SiRNA target sequence
tatgatacttgtctaatatctggaatt

SEQ ID NO: 251386 - DNA, 27 bp, Artificial sequence
  SiRNA target sequence
atgatacttgtctaatatctggaattt

SEQ ID NO: 251387 - DNA, 27 bp, Artificial sequence
  SiRNA target sequence
tgatacttgtctaatatctggaatttc

SEQ ID NO: 251388 - DNA, 27 bp, Artificial sequence
  SiRNA target sequence
gatacttgtctaatatctggaatttct

SEQ ID NO: 251389 - DNA, 27 bp, Artificial sequence
  SiRNA target sequence
atacttgtctaatatctggaatttcta

SEQ ID NO: 251390 - DNA, 27 bp, Artificial sequence
  SiRNA target sequence
tacttgtctaatatctggaatttctat

SEQ ID NO: 251391 - DNA, 27 bp, Artificial sequence
  SiRNA target sequence
acttgtctaatatctggaatttctata

SEQ ID NO: 251392 - DNA, 27 bp, Artificial sequence
  SiRNA target sequence
cttgtctaatatctggaatttctataa

SEQ ID NO: 251393 - DNA, 27 bp, Artificial sequence
  SiRNA target sequence
ttgtctaatatctggaatttctataaa

SEQ ID NO: 251394 - DNA, 27 bp, Artificial sequence
  SiRNA target sequence
tgtctaatatctggaatttctataaac

SEQ ID NO: 251395 - DNA, 27 bp, Artificial sequence
  SiRNA target sequence
gtctaatatctggaatttctataaacg

SEQ ID NO: 251396 - DNA, 27 bp, Artificial sequence
  SiRNA target sequence
tctaatatctggaatttctataaacgt

SEQ ID NO: 251397 - DNA, 27 bp, Artificial sequence
  SiRNA target sequence
ctaatatctggaatttctataaacgtc

SEQ ID NO: 251398 - DNA, 27 bp, Artificial sequence
  SiRNA target sequence
taatatctggaatttctataaacgtca

SEQ ID NO: 251399 - DNA, 27 bp, Artificial sequence
  SiRNA target sequence
aatatctggaatttctataaacgtcaa

SEQ ID NO: 251400 - DNA, 27 bp, Artificial sequence
  SiRNA target sequence
atatctggaatttctataaacgtcaaa

SEQ ID NO: 251401 - DNA, 27 bp, Artificial sequence
  SiRNA target sequence
tatctggaatttctataaacgtcaaaa

SEQ ID NO: 251402 - DNA, 27 bp, Artificial sequence
  SiRNA target sequence
atctggaatttctataaacgtcaaaaa

SEQ ID NO: 251403 - DNA, 27 bp, Artificial sequence
  SiRNA target sequence
tctggaatttctataaacgtcaaaaaa

SEQ ID NO: 251404 - DNA, 27 bp, Artificial sequence
  SiRNA target sequence
ctggaatttctataaacgtcaaaaaag

SEQ ID NO: 251405 - DNA, 27 bp, Artificial sequence
  SiRNA target sequence
tggaatttctataaacgtcaaaaaagt

SEQ ID NO: 251406 - DNA, 27 bp, Artificial sequence
  SiRNA target sequence
ggaatttctataaacgtcaaaaaagtt

SEQ ID NO: 251407 - DNA, 27 bp, Artificial sequence
  SiRNA target sequence
gaatttctataaacgtcaaaaaagttc

SEQ ID NO: 251408 - DNA, 27 bp, Artificial sequence
  SiRNA target sequence
aatttctataaacgtcaaaaaagttcc

SEQ ID NO: 251409 - DNA, 27 bp, Artificial sequence
  SiRNA target sequence
atttctataaacgtcaaaaaagttcca

SEQ ID NO: 251410 - DNA, 27 bp, Artificial sequence
  SiRNA target sequence
tttctataaacgtcaaaaaagttccat

SEQ ID NO: 251411 - DNA, 27 bp, Artificial sequence
  SiRNA target sequence
ttctataaacgtcaaaaaagttccata

SEQ ID NO: 251412 - DNA, 27 bp, Artificial sequence
  SiRNA target sequence
tctataaacgtcaaaaaagttccatat

SEQ ID NO: 251413 - DNA, 27 bp, Artificial sequence
  SiRNA target sequence
ctataaacgtcaaaaaagttccatata

SEQ ID NO: 251414 - DNA, 27 bp, Artificial sequence
  SiRNA target sequence
tataaacgtcaaaaaagttccatataa

SEQ ID NO: 251415 - DNA, 27 bp, Artificial sequence
  SiRNA target sequence
ataaacgtcaaaaaagttccatataaa

SEQ ID NO: 251416 - DNA, 27 bp, Artificial sequence
  SiRNA target sequence
taaacgtcaaaaaagttccatataaag

SEQ ID NO: 251417 - DNA, 27 bp, Artificial sequence
  SiRNA target sequence
aaacgtcaaaaaagttccatataaaga

SEQ ID NO: 251418 - DNA, 27 bp, Artificial sequence
  SiRNA target sequence
aacgtcaaaaaagttccatataaagag

SEQ ID NO: 251419 - DNA, 27 bp, Artificial sequence
  SiRNA target sequence
acgtcaaaaaagttccatataaagaga

SEQ ID NO: 251420 - DNA, 27 bp, Artificial sequence
  SiRNA target sequence
cgtcaaaaaagttccatataaagagat

SEQ ID NO: 251421 - DNA, 27 bp, Artificial sequence
  SiRNA target sequence
gtcaaaaaagttccatataaagagata

SEQ ID NO: 251422 - DNA, 27 bp, Artificial sequence
  SiRNA target sequence
tcaaaaaagttccatataaagagataa

SEQ ID NO: 251423 - DNA, 27 bp, Artificial sequence
  SiRNA target sequence
caaaaaagttccatataaagagataat

SEQ ID NO: 251424 - DNA, 27 bp, Artificial sequence
  SiRNA target sequence
aaaaaagttccatataaagagataata

SEQ ID NO: 251425 - DNA, 27 bp, Artificial sequence
  SiRNA target sequence
aaaaagttccatataaagagataatag

SEQ ID NO: 251426 - DNA, 27 bp, Artificial sequence
  SiRNA target sequence
aaaagttccatataaagagataataga

SEQ ID NO: 251427 - DNA, 27 bp, Artificial sequence
  SiRNA target sequence
aaagttccatataaagagataatagat

SEQ ID NO: 251428 - DNA, 27 bp, Artificial sequence
  SiRNA target sequence
aagttccatataaagagataatagatt

SEQ ID NO: 251429 - DNA, 27 bp, Artificial sequence
  SiRNA target sequence
agttccatataaagagataatagattt

SEQ ID NO: 251430 - DNA, 27 bp, Artificial sequence
  SiRNA target sequence
gttccatataaagagataatagattta

SEQ ID NO: 251431 - DNA, 27 bp, Artificial sequence
  SiRNA target sequence
ttccatataaagagataatagatttac

SEQ ID NO: 251432 - DNA, 27 bp, Artificial sequence
  SiRNA target sequence
tccatataaagagataatagatttacc

SEQ ID NO: 251433 - DNA, 27 bp, Artificial sequence
  SiRNA target sequence
ccatataaagagataatagatttacca

SEQ ID NO: 251434 - DNA, 27 bp, Artificial sequence
  SiRNA target sequence
catataaagagataatagatttaccaa

SEQ ID NO: 251435 - DNA, 27 bp, Artificial sequence
  SiRNA target sequence
atataaagagataatagatttaccaat

SEQ ID NO: 251436 - DNA, 27 bp, Artificial sequence
  SiRNA target sequence
tataaagagataatagatttaccaatt

SEQ ID NO: 251437 - DNA, 27 bp, Artificial sequence
  SiRNA target sequence
ataaagagataatagatttaccaattt

SEQ ID NO: 251438 - DNA, 27 bp, Artificial sequence
  SiRNA target sequence
taaagagataatagatttaccaatttt

SEQ ID NO: 251439 - DNA, 27 bp, Artificial sequence
  SiRNA target sequence
aaagagataatagatttaccaattttg

SEQ ID NO: 251440 - DNA, 27 bp, Artificial sequence
  SiRNA target sequence
aagagataatagatttaccaattttga

SEQ ID NO: 251441 - DNA, 27 bp, Artificial sequence
  SiRNA target sequence
agagataatagatttaccaattttgat

SEQ ID NO: 251442 - DNA, 27 bp, Artificial sequence
  SiRNA target sequence
gagataatagatttaccaattttgata

SEQ ID NO: 251443 - DNA, 27 bp, Artificial sequence
  SiRNA target sequence
agataatagatttaccaattttgatac

SEQ ID NO: 251444 - DNA, 27 bp, Artificial sequence
  SiRNA target sequence
gataatagatttaccaattttgataca

SEQ ID NO: 251445 - DNA, 27 bp, Artificial sequence
  SiRNA target sequence
ataatagatttaccaattttgatacat

SEQ ID NO: 251446 - DNA, 27 bp, Artificial sequence
  SiRNA target sequence
taatagatttaccaattttgatacata

SEQ ID NO: 251447 - DNA, 27 bp, Artificial sequence
  SiRNA target sequence
aatagatttaccaattttgatacatac

SEQ ID NO: 251448 - DNA, 27 bp, Artificial sequence
  SiRNA target sequence
atagatttaccaattttgatacataca

SEQ ID NO: 251449 - DNA, 27 bp, Artificial sequence
  SiRNA target sequence
tagatttaccaattttgatacatacac

SEQ ID NO: 251450 - DNA, 27 bp, Artificial sequence
  SiRNA target sequence
agatttaccaattttgatacatacacc

SEQ ID NO: 251451 - DNA, 27 bp, Artificial sequence
  SiRNA target sequence
gatttaccaattttgatacatacacca

SEQ ID NO: 251452 - DNA, 27 bp, Artificial sequence
  SiRNA target sequence
atttaccaattttgatacatacaccat

SEQ ID NO: 251453 - DNA, 27 bp, Artificial sequence
  SiRNA target sequence
tttaccaattttgatacatacaccatc

SEQ ID NO: 251454 - DNA, 27 bp, Artificial sequence
  SiRNA target sequence
ttaccaattttgatacatacaccatca

SEQ ID NO: 251455 - DNA, 27 bp, Artificial sequence
  SiRNA target sequence
taccaattttgatacatacaccatcat

SEQ ID NO: 251456 - DNA, 27 bp, Artificial sequence
  SiRNA target sequence
accaattttgatacatacaccatcata

SEQ ID NO: 251457 - DNA, 27 bp, Artificial sequence
  SiRNA target sequence
ccaattttgatacatacaccatcataa

SEQ ID NO: 251458 - DNA, 27 bp, Artificial sequence
  SiRNA target sequence
caattttgatacatacaccatcataaa

SEQ ID NO: 251459 - DNA, 27 bp, Artificial sequence
  SiRNA target sequence
aattttgatacatacaccatcataaaa

SEQ ID NO: 251460 - DNA, 27 bp, Artificial sequence
  SiRNA target sequence
attttgatacatacaccatcataaaaa

SEQ ID NO: 251461 - DNA, 27 bp, Artificial sequence
  SiRNA target sequence
ttttgatacatacaccatcataaaaac

SEQ ID NO: 251462 - DNA, 27 bp, Artificial sequence
  SiRNA target sequence
tttgatacatacaccatcataaaaact

SEQ ID NO: 251463 - DNA, 27 bp, Artificial sequence
  SiRNA target sequence
ttgatacatacaccatcataaaaactt

SEQ ID NO: 251464 - DNA, 27 bp, Artificial sequence
  SiRNA target sequence
tgatacatacaccatcataaaaacttt

SEQ ID NO: 251465 - DNA, 27 bp, Artificial sequence
  SiRNA target sequence
gatacatacaccatcataaaaactttt

SEQ ID NO: 251466 - DNA, 27 bp, Artificial sequence
  SiRNA target sequence
atacatacaccatcataaaaactttta

SEQ ID NO: 251467 - DNA, 27 bp, Artificial sequence
  SiRNA target sequence
tacatacaccatcataaaaacttttaa

SEQ ID NO: 251468 - DNA, 27 bp, Artificial sequence
  SiRNA target sequence
acatacaccatcataaaaacttttaaa

SEQ ID NO: 251469 - DNA, 27 bp, Artificial sequence
  SiRNA target sequence
catacaccatcataaaaacttttaaat

SEQ ID NO: 251470 - DNA, 27 bp, Artificial sequence
  SiRNA target sequence
atacaccatcataaaaacttttaaatt

SEQ ID NO: 251471 - DNA, 27 bp, Artificial sequence
  SiRNA target sequence
tacaccatcataaaaacttttaaattt

SEQ ID NO: 251472 - DNA, 27 bp, Artificial sequence
  SiRNA target sequence
acaccatcataaaaacttttaaattta

SEQ ID NO: 251473 - DNA, 27 bp, Artificial sequence
  SiRNA target sequence
caccatcataaaaacttttaaatttat

SEQ ID NO: 251474 - DNA, 27 bp, Artificial sequence
  SiRNA target sequence
accatcataaaaacttttaaatttata

SEQ ID NO: 251475 - DNA, 27 bp, Artificial sequence
  SiRNA target sequence
ccatcataaaaacttttaaatttatac

SEQ ID NO: 251476 - DNA, 27 bp, Artificial sequence
  SiRNA target sequence
catcataaaaacttttaaatttatacc

SEQ ID NO: 251477 - DNA, 27 bp, Artificial sequence
  SiRNA target sequence
atcataaaaacttttaaatttatacct

SEQ ID NO: 251478 - DNA, 27 bp, Artificial sequence
  SiRNA target sequence
tcataaaaacttttaaatttatacctg

SEQ ID NO: 251479 - DNA, 27 bp, Artificial sequence
  SiRNA target sequence
cataaaaacttttaaatttatacctgt

SEQ ID NO: 251480 - DNA, 27 bp, Artificial sequence
  SiRNA target sequence
ataaaaacttttaaatttatacctgta

SEQ ID NO: 251481 - DNA, 27 bp, Artificial sequence
  SiRNA target sequence
taaaaacttttaaatttatacctgtat

SEQ ID NO: 251482 - DNA, 27 bp, Artificial sequence
  SiRNA target sequence
aaaaacttttaaatttatacctgtatt

SEQ ID NO: 251483 - DNA, 27 bp, Artificial sequence
  SiRNA target sequence
aaaacttttaaatttatacctgtattt

SEQ ID NO: 251484 - DNA, 27 bp, Artificial sequence
  SiRNA target sequence
aaacttttaaatttatacctgtattta

SEQ ID NO: 251485 - DNA, 27 bp, Artificial sequence
  SiRNA target sequence
aacttttaaatttatacctgtatttaa

SEQ ID NO: 251486 - DNA, 27 bp, Artificial sequence
  SiRNA target sequence
acttttaaatttatacctgtatttaac

SEQ ID NO: 251487 - DNA, 27 bp, Artificial sequence
  SiRNA target sequence
cttttaaatttatacctgtatttaaca

SEQ ID NO: 251488 - DNA, 27 bp, Artificial sequence
  SiRNA target sequence
ttttaaatttatacctgtatttaacag

SEQ ID NO: 251489 - DNA, 27 bp, Artificial sequence
  SiRNA target sequence
tttaaatttatacctgtatttaacagg

SEQ ID NO: 251490 - DNA, 27 bp, Artificial sequence
  SiRNA target sequence
ttaaatttatacctgtatttaacaggc

SEQ ID NO: 251491 - DNA, 27 bp, Artificial sequence
  SiRNA target sequence
taaatttatacctgtatttaacaggca

SEQ ID NO: 251492 - DNA, 27 bp, Artificial sequence
  SiRNA target sequence
aaatttatacctgtatttaacaggcac

SEQ ID NO: 251493 - DNA, 27 bp, Artificial sequence
  SiRNA target sequence
aatttatacctgtatttaacaggcacc

SEQ ID NO: 251494 - DNA, 27 bp, Artificial sequence
  SiRNA target sequence
atttatacctgtatttaacaggcaccc

SEQ ID NO: 251495 - DNA, 27 bp, Artificial sequence
  SiRNA target sequence
tttatacctgtatttaacaggcaccct

SEQ ID NO: 251496 - DNA, 27 bp, Artificial sequence
  SiRNA target sequence
ttatacctgtatttaacaggcaccctc

SEQ ID NO: 251497 - DNA, 27 bp, Artificial sequence
  SiRNA target sequence
tatacctgtatttaacaggcaccctca

SEQ ID NO: 251498 - DNA, 27 bp, Artificial sequence
  SiRNA target sequence
atacctgtatttaacaggcaccctcat

SEQ ID NO: 251499 - DNA, 27 bp, Artificial sequence
  SiRNA target sequence
tacctgtatttaacaggcaccctcata

SEQ ID NO: 251500 - DNA, 27 bp, Artificial sequence
  SiRNA target sequence
acctgtatttaacaggcaccctcatag

SEQ ID NO: 251501 - DNA, 27 bp, Artificial sequence
  SiRNA target sequence
cctgtatttaacaggcaccctcataga

SEQ ID NO: 251502 - DNA, 27 bp, Artificial sequence
  SiRNA target sequence
ctgtatttaacaggcaccctcatagaa

SEQ ID NO: 251503 - DNA, 27 bp, Artificial sequence
  SiRNA target sequence
tgtatttaacaggcaccctcatagaaa

SEQ ID NO: 251504 - DNA, 27 bp, Artificial sequence
  SiRNA target sequence
gtatttaacaggcaccctcatagaaag

SEQ ID NO: 251505 - DNA, 27 bp, Artificial sequence
  SiRNA target sequence
tatttaacaggcaccctcatagaaagc

SEQ ID NO: 251506 - DNA, 27 bp, Artificial sequence
  SiRNA target sequence
atttaacaggcaccctcatagaaagca

SEQ ID NO: 251507 - DNA, 27 bp, Artificial sequence
  SiRNA target sequence
tttaacaggcaccctcatagaaagcat

SEQ ID NO: 251508 - DNA, 27 bp, Artificial sequence
  SiRNA target sequence
ttaacaggcaccctcatagaaagcatt

SEQ ID NO: 251509 - DNA, 27 bp, Artificial sequence
  SiRNA target sequence
taacaggcaccctcatagaaagcattt

SEQ ID NO: 251510 - DNA, 27 bp, Artificial sequence
  SiRNA target sequence
aacaggcaccctcatagaaagcatttc

SEQ ID NO: 251511 - DNA, 27 bp, Artificial sequence
  SiRNA target sequence
acaggcaccctcatagaaagcatttct

SEQ ID NO: 251512 - DNA, 27 bp, Artificial sequence
  SiRNA target sequence
caggcaccctcatagaaagcatttctt

SEQ ID NO: 251513 - DNA, 27 bp, Artificial sequence
  SiRNA target sequence
aggcaccctcatagaaagcatttcttt

SEQ ID NO: 251514 - DNA, 27 bp, Artificial sequence
  SiRNA target sequence
ggcaccctcatagaaagcatttctttt

SEQ ID NO: 251515 - DNA, 27 bp, Artificial sequence
  SiRNA target sequence
gcaccctcatagaaagcatttcttttg

SEQ ID NO: 251516 - DNA, 27 bp, Artificial sequence
  SiRNA target sequence
caccctcatagaaagcatttcttttgc

SEQ ID NO: 251517 - DNA, 27 bp, Artificial sequence
  SiRNA target sequence
accctcatagaaagcatttcttttgct

SEQ ID NO: 251518 - DNA, 27 bp, Artificial sequence
  SiRNA target sequence
ccctcatagaaagcatttcttttgcta

SEQ ID NO: 251519 - DNA, 27 bp, Artificial sequence
  SiRNA target sequence
cctcatagaaagcatttcttttgctaa

SEQ ID NO: 251520 - DNA, 27 bp, Artificial sequence
  SiRNA target sequence
ctcatagaaagcatttcttttgctaaa

SEQ ID NO: 251521 - DNA, 27 bp, Artificial sequence
  SiRNA target sequence
tcatagaaagcatttcttttgctaaat

SEQ ID NO: 251522 - DNA, 27 bp, Artificial sequence
  SiRNA target sequence
catagaaagcatttcttttgctaaatc

SEQ ID NO: 251523 - DNA, 27 bp, Artificial sequence
  SiRNA target sequence
atagaaagcatttcttttgctaaatca

SEQ ID NO: 251524 - DNA, 27 bp, Artificial sequence
  SiRNA target sequence
tagaaagcatttcttttgctaaatcaa

SEQ ID NO: 251525 - DNA, 27 bp, Artificial sequence
  SiRNA target sequence
agaaagcatttcttttgctaaatcaaa

SEQ ID NO: 251526 - DNA, 27 bp, Artificial sequence
  SiRNA target sequence
gaaagcatttcttttgctaaatcaaat

SEQ ID NO: 251527 - DNA, 27 bp, Artificial sequence
  SiRNA target sequence
aaagcatttcttttgctaaatcaaata

SEQ ID NO: 251528 - DNA, 27 bp, Artificial sequence
  SiRNA target sequence
aagcatttcttttgctaaatcaaataa

SEQ ID NO: 251529 - DNA, 27 bp, Artificial sequence
  SiRNA target sequence
agcatttcttttgctaaatcaaataaa

SEQ ID NO: 251530 - DNA, 27 bp, Artificial sequence
  SiRNA target sequence
gcatttcttttgctaaatcaaataaaa

SEQ ID NO: 251531 - DNA, 27 bp, Artificial sequence
  SiRNA target sequence
catttcttttgctaaatcaaataaaac

SEQ ID NO: 251532 - DNA, 27 bp, Artificial sequence
  SiRNA target sequence
atttcttttgctaaatcaaataaaaca

SEQ ID NO: 251533 - DNA, 27 bp, Artificial sequence
  SiRNA target sequence
tttcttttgctaaatcaaataaaacat

SEQ ID NO: 251534 - DNA, 27 bp, Artificial sequence
  SiRNA target sequence
ttcttttgctaaatcaaataaaacata

SEQ ID NO: 251535 - DNA, 27 bp, Artificial sequence
  SiRNA target sequence
tcttttgctaaatcaaataaaacatat

SEQ ID NO: 251536 - DNA, 27 bp, Artificial sequence
  SiRNA target sequence
cttttgctaaatcaaataaaacatatt

SEQ ID NO: 251537 - DNA, 27 bp, Artificial sequence
  SiRNA target sequence
ttttgctaaatcaaataaaacatattt

SEQ ID NO: 251538 - DNA, 27 bp, Artificial sequence
  SiRNA target sequence
tttgctaaatcaaataaaacatatttg

SEQ ID NO: 251539 - DNA, 27 bp, Artificial sequence
  SiRNA target sequence
ttgctaaatcaaataaaacatatttgg

SEQ ID NO: 251540 - DNA, 27 bp, Artificial sequence
  SiRNA target sequence
tgctaaatcaaataaaacatatttggt

SEQ ID NO: 251541 - DNA, 27 bp, Artificial sequence
  SiRNA target sequence
gctaaatcaaataaaacatatttggta

SEQ ID NO: 251542 - DNA, 27 bp, Artificial sequence
  SiRNA target sequence
ctaaatcaaataaaacatatttggtaa

SEQ ID NO: 251543 - DNA, 27 bp, Artificial sequence
  SiRNA target sequence
taaatcaaataaaacatatttggtaat

SEQ ID NO: 251544 - DNA, 27 bp, Artificial sequence
  SiRNA target sequence
aaatcaaataaaacatatttggtaatt

SEQ ID NO: 251545 - DNA, 27 bp, Artificial sequence
  SiRNA target sequence
aatcaaataaaacatatttggtaattt

SEQ ID NO: 251546 - DNA, 27 bp, Artificial sequence
  SiRNA target sequence
atcaaataaaacatatttggtaatttt

SEQ ID NO: 251547 - DNA, 27 bp, Artificial sequence
  SiRNA target sequence
tcaaataaaacatatttggtaatttta

SEQ ID NO: 251548 - DNA, 27 bp, Artificial sequence
  SiRNA target sequence
caaataaaacatatttggtaattttag

SEQ ID NO: 251549 - DNA, 27 bp, Artificial sequence
  SiRNA target sequence
aaataaaacatatttggtaattttaga

SEQ ID NO: 251550 - DNA, 27 bp, Artificial sequence
  SiRNA target sequence
aataaaacatatttggtaattttagaa

SEQ ID NO: 251551 - DNA, 27 bp, Artificial sequence
  SiRNA target sequence
ataaaacatatttggtaattttagaaa

SEQ ID NO: 251552 - DNA, 27 bp, Artificial sequence
  SiRNA target sequence
taaaacatatttggtaattttagaaaa

SEQ ID NO: 251553 - DNA, 27 bp, Artificial sequence
  SiRNA target sequence
aaaacatatttggtaattttagaaaat

SEQ ID NO: 251554 - DNA, 27 bp, Artificial sequence
  SiRNA target sequence
aaacatatttggtaattttagaaaatg

SEQ ID NO: 251555 - DNA, 27 bp, Artificial sequence
  SiRNA target sequence
aacatatttggtaattttagaaaatgc

SEQ ID NO: 251556 - DNA, 27 bp, Artificial sequence
  SiRNA target sequence
acatatttggtaattttagaaaatgca

SEQ ID NO: 251557 - DNA, 27 bp, Artificial sequence
  SiRNA target sequence
catatttggtaattttagaaaatgcaa

SEQ ID NO: 251558 - DNA, 27 bp, Artificial sequence
  SiRNA target sequence
atatttggtaattttagaaaatgcaaa

SEQ ID NO: 251559 - DNA, 27 bp, Artificial sequence
  SiRNA target sequence
tatttggtaattttagaaaatgcaaat

SEQ ID NO: 251560 - DNA, 27 bp, Artificial sequence
  SiRNA target sequence
atttggtaattttagaaaatgcaaatc

SEQ ID NO: 251561 - DNA, 27 bp, Artificial sequence
  SiRNA target sequence
tttggtaattttagaaaatgcaaatcc

SEQ ID NO: 251562 - DNA, 27 bp, Artificial sequence
  SiRNA target sequence
ttggtaattttagaaaatgcaaatcca

SEQ ID NO: 251563 - DNA, 27 bp, Artificial sequence
  SiRNA target sequence
tggtaattttagaaaatgcaaatccaa

SEQ ID NO: 251564 - DNA, 27 bp, Artificial sequence
  SiRNA target sequence
ggtaattttagaaaatgcaaatccaat

SEQ ID NO: 251565 - DNA, 27 bp, Artificial sequence
  SiRNA target sequence
gtaattttagaaaatgcaaatccaatg

SEQ ID NO: 251566 - DNA, 27 bp, Artificial sequence
  SiRNA target sequence
taattttagaaaatgcaaatccaatgg

SEQ ID NO: 251567 - DNA, 27 bp, Artificial sequence
  SiRNA target sequence
aattttagaaaatgcaaatccaatggt

SEQ ID NO: 251568 - DNA, 27 bp, Artificial sequence
  SiRNA target sequence
attttagaaaatgcaaatccaatggtt

SEQ ID NO: 251569 - DNA, 27 bp, Artificial sequence
  SiRNA target sequence
ttttagaaaatgcaaatccaatggttg

SEQ ID NO: 251570 - DNA, 27 bp, Artificial sequence
  SiRNA target sequence
tttagaaaatgcaaatccaatggttgc

SEQ ID NO: 251571 - DNA, 27 bp, Artificial sequence
  SiRNA target sequence
ttagaaaatgcaaatccaatggttgca

SEQ ID NO: 251572 - DNA, 27 bp, Artificial sequence
  SiRNA target sequence
tagaaaatgcaaatccaatggttgcac

SEQ ID NO: 251573 - DNA, 27 bp, Artificial sequence
  SiRNA target sequence
agaaaatgcaaatccaatggttgcaca

SEQ ID NO: 251574 - DNA, 27 bp, Artificial sequence
  SiRNA target sequence
gaaaatgcaaatccaatggttgcacac

SEQ ID NO: 251575 - DNA, 27 bp, Artificial sequence
  SiRNA target sequence
aaaatgcaaatccaatggttgcacacc

SEQ ID NO: 251576 - DNA, 27 bp, Artificial sequence
  SiRNA target sequence
aaatgcaaatccaatggttgcacacca

SEQ ID NO: 251577 - DNA, 27 bp, Artificial sequence
  SiRNA target sequence
aatgcaaatccaatggttgcacaccaa

SEQ ID NO: 251578 - DNA, 27 bp, Artificial sequence
  SiRNA target sequence
atgcaaatccaatggttgcacaccaat

SEQ ID NO: 251579 - DNA, 27 bp, Artificial sequence
  SiRNA target sequence
tgcaaatccaatggttgcacaccaatt

SEQ ID NO: 251580 - DNA, 27 bp, Artificial sequence
  SiRNA target sequence
gcaaatccaatggttgcacaccaattt

SEQ ID NO: 251581 - DNA, 27 bp, Artificial sequence
  SiRNA target sequence
caaatccaatggttgcacaccaatttt

SEQ ID NO: 251582 - DNA, 27 bp, Artificial sequence
  SiRNA target sequence
aaatccaatggttgcacaccaattttc

SEQ ID NO: 251583 - DNA, 27 bp, Artificial sequence
  SiRNA target sequence
aatccaatggttgcacaccaattttca

SEQ ID NO: 251584 - DNA, 27 bp, Artificial sequence
  SiRNA target sequence
atccaatggttgcacaccaattttcaa

SEQ ID NO: 251585 - DNA, 27 bp, Artificial sequence
  SiRNA target sequence
tccaatggttgcacaccaattttcaag

SEQ ID NO: 251586 - DNA, 27 bp, Artificial sequence
  SiRNA target sequence
ccaatggttgcacaccaattttcaaga

SEQ ID NO: 251587 - DNA, 27 bp, Artificial sequence
  SiRNA target sequence
caatggttgcacaccaattttcaagat

SEQ ID NO: 251588 - DNA, 27 bp, Artificial sequence
  SiRNA target sequence
aatggttgcacaccaattttcaagatt

SEQ ID NO: 251589 - DNA, 27 bp, Artificial sequence
  SiRNA target sequence
atggttgcacaccaattttcaagattt

SEQ ID NO: 251590 - DNA, 27 bp, Artificial sequence
  SiRNA target sequence
tggttgcacaccaattttcaagattta

SEQ ID NO: 251591 - DNA, 27 bp, Artificial sequence
  SiRNA target sequence
ggttgcacaccaattttcaagatttat

SEQ ID NO: 251592 - DNA, 27 bp, Artificial sequence
  SiRNA target sequence
gttgcacaccaattttcaagatttatt

SEQ ID NO: 251593 - DNA, 27 bp, Artificial sequence
  SiRNA target sequence
ttgcacaccaattttcaagatttattc

SEQ ID NO: 251594 - DNA, 27 bp, Artificial sequence
  SiRNA target sequence
tgcacaccaattttcaagatttattct

SEQ ID NO: 251595 - DNA, 27 bp, Artificial sequence
  SiRNA target sequence
gcacaccaattttcaagatttattctt

SEQ ID NO: 251596 - DNA, 27 bp, Artificial sequence
  SiRNA target sequence
cacaccaattttcaagatttattctta

SEQ ID NO: 251597 - DNA, 27 bp, Artificial sequence
  SiRNA target sequence
acaccaattttcaagatttattcttaa

SEQ ID NO: 251598 - DNA, 27 bp, Artificial sequence
  SiRNA target sequence
caccaattttcaagatttattcttaag

SEQ ID NO: 251599 - DNA, 27 bp, Artificial sequence
  SiRNA target sequence
accaattttcaagatttattcttaaga

SEQ ID NO: 251600 - DNA, 27 bp, Artificial sequence
  SiRNA target sequence
ccaattttcaagatttattcttaagac

SEQ ID NO: 251601 - DNA, 27 bp, Artificial sequence
  SiRNA target sequence
caattttcaagatttattcttaagacc

SEQ ID NO: 251602 - DNA, 27 bp, Artificial sequence
  SiRNA target sequence
aattttcaagatttattcttaagaccg

SEQ ID NO: 251603 - DNA, 27 bp, Artificial sequence
  SiRNA target sequence
attttcaagatttattcttaagaccga

SEQ ID NO: 251604 - DNA, 27 bp, Artificial sequence
  SiRNA target sequence
ttttcaagatttattcttaagaccgat

SEQ ID NO: 251605 - DNA, 27 bp, Artificial sequence
  SiRNA target sequence
tttcaagatttattcttaagaccgatg

SEQ ID NO: 251606 - DNA, 27 bp, Artificial sequence
  SiRNA target sequence
ttcaagatttattcttaagaccgatgg

SEQ ID NO: 251607 - DNA, 27 bp, Artificial sequence
  SiRNA target sequence
tcaagatttattcttaagaccgatgga

SEQ ID NO: 251608 - DNA, 27 bp, Artificial sequence
  SiRNA target sequence
caagatttattcttaagaccgatggag

SEQ ID NO: 251609 - DNA, 27 bp, Artificial sequence
  SiRNA target sequence
aagatttattcttaagaccgatggagc

SEQ ID NO: 251610 - DNA, 27 bp, Artificial sequence
  SiRNA target sequence
agatttattcttaagaccgatggagct

SEQ ID NO: 251611 - DNA, 27 bp, Artificial sequence
  SiRNA target sequence
gatttattcttaagaccgatggagctg

SEQ ID NO: 251612 - DNA, 27 bp, Artificial sequence
  SiRNA target sequence
atttattcttaagaccgatggagctgt

SEQ ID NO: 251613 - DNA, 27 bp, Artificial sequence
  SiRNA target sequence
tttattcttaagaccgatggagctgtg

SEQ ID NO: 251614 - DNA, 27 bp, Artificial sequence
  SiRNA target sequence
ttattcttaagaccgatggagctgtgc

SEQ ID NO: 251615 - DNA, 27 bp, Artificial sequence
  SiRNA target sequence
tattcttaagaccgatggagctgtgcg

SEQ ID NO: 251616 - DNA, 27 bp, Artificial sequence
  SiRNA target sequence
attcttaagaccgatggagctgtgcgc

SEQ ID NO: 251617 - DNA, 27 bp, Artificial sequence
  SiRNA target sequence
ttcttaagaccgatggagctgtgcgca

SEQ ID NO: 251618 - DNA, 27 bp, Artificial sequence
  SiRNA target sequence
tcttaagaccgatggagctgtgcgcaa

SEQ ID NO: 251619 - DNA, 27 bp, Artificial sequence
  SiRNA target sequence
cttaagaccgatggagctgtgcgcaaa

SEQ ID NO: 251620 - DNA, 27 bp, Artificial sequence
  SiRNA target sequence
ttaagaccgatggagctgtgcgcaaat

SEQ ID NO: 251621 - DNA, 27 bp, Artificial sequence
  SiRNA target sequence
taagaccgatggagctgtgcgcaaatt

SEQ ID NO: 251622 - DNA, 27 bp, Artificial sequence
  SiRNA target sequence
aagaccgatggagctgtgcgcaaattg

SEQ ID NO: 251623 - DNA, 27 bp, Artificial sequence
  SiRNA target sequence
agaccgatggagctgtgcgcaaattgt

SEQ ID NO: 251624 - DNA, 27 bp, Artificial sequence
  SiRNA target sequence
gaccgatggagctgtgcgcaaattgta

SEQ ID NO: 251625 - DNA, 27 bp, Artificial sequence
  SiRNA target sequence
accgatggagctgtgcgcaaattgtaa

SEQ ID NO: 251626 - DNA, 27 bp, Artificial sequence
  SiRNA target sequence
ccgatggagctgtgcgcaaattgtaaa

SEQ ID NO: 251627 - DNA, 27 bp, Artificial sequence
  SiRNA target sequence
cgatggagctgtgcgcaaattgtaaaa

SEQ ID NO: 251628 - DNA, 27 bp, Artificial sequence
  SiRNA target sequence
gatggagctgtgcgcaaattgtaaaaa

SEQ ID NO: 251629 - DNA, 27 bp, Artificial sequence
  SiRNA target sequence
atggagctgtgcgcaaattgtaaaaag

SEQ ID NO: 251630 - DNA, 27 bp, Artificial sequence
  SiRNA target sequence
tggagctgtgcgcaaattgtaaaaaga

SEQ ID NO: 251631 - DNA, 27 bp, Artificial sequence
  SiRNA target sequence
ggagctgtgcgcaaattgtaaaaagaa

SEQ ID NO: 251632 - DNA, 27 bp, Artificial sequence
  SiRNA target sequence
gagctgtgcgcaaattgtaaaaagaaa

SEQ ID NO: 251633 - DNA, 27 bp, Artificial sequence
  SiRNA target sequence
agctgtgcgcaaattgtaaaaagaaag

SEQ ID NO: 251634 - DNA, 27 bp, Artificial sequence
  SiRNA target sequence
gctgtgcgcaaattgtaaaaagaaagt

SEQ ID NO: 251635 - DNA, 27 bp, Artificial sequence
  SiRNA target sequence
ctgtgcgcaaattgtaaaaagaaagtc

SEQ ID NO: 251636 - DNA, 27 bp, Artificial sequence
  SiRNA target sequence
tgtgcgcaaattgtaaaaagaaagtcc

SEQ ID NO: 251637 - DNA, 27 bp, Artificial sequence
  SiRNA target sequence
gtgcgcaaattgtaaaaagaaagtcct

SEQ ID NO: 251638 - DNA, 27 bp, Artificial sequence
  SiRNA target sequence
tgcgcaaattgtaaaaagaaagtcctg

SEQ ID NO: 251639 - DNA, 27 bp, Artificial sequence
  SiRNA target sequence
gcgcaaattgtaaaaagaaagtcctga

SEQ ID NO: 251640 - DNA, 27 bp, Artificial sequence
  SiRNA target sequence
cgcaaattgtaaaaagaaagtcctgaa

SEQ ID NO: 251641 - DNA, 27 bp, Artificial sequence
  SiRNA target sequence
gcaaattgtaaaaagaaagtcctgaaa

SEQ ID NO: 251642 - DNA, 27 bp, Artificial sequence
  SiRNA target sequence
caaattgtaaaaagaaagtcctgaaat

SEQ ID NO: 251643 - DNA, 27 bp, Artificial sequence
  SiRNA target sequence
aaattgtaaaaagaaagtcctgaaatt

SEQ ID NO: 251644 - DNA, 27 bp, Artificial sequence
  SiRNA target sequence
aattgtaaaaagaaagtcctgaaatta

SEQ ID NO: 251645 - DNA, 27 bp, Artificial sequence
  SiRNA target sequence
attgtaaaaagaaagtcctgaaattag

SEQ ID NO: 251646 - DNA, 27 bp, Artificial sequence
  SiRNA target sequence
ttgtaaaaagaaagtcctgaaattaga

SEQ ID NO: 251647 - DNA, 27 bp, Artificial sequence
  SiRNA target sequence
tgtaaaaagaaagtcctgaaattagag

SEQ ID NO: 251648 - DNA, 27 bp, Artificial sequence
  SiRNA target sequence
gtaaaaagaaagtcctgaaattagagc

SEQ ID NO: 251649 - DNA, 27 bp, Artificial sequence
  SiRNA target sequence
taaaaagaaagtcctgaaattagagcg

SEQ ID NO: 251650 - DNA, 27 bp, Artificial sequence
  SiRNA target sequence
aaaaagaaagtcctgaaattagagcgg

SEQ ID NO: 251651 - DNA, 27 bp, Artificial sequence
  SiRNA target sequence
aaaagaaagtcctgaaattagagcggt

SEQ ID NO: 251652 - DNA, 27 bp, Artificial sequence
  SiRNA target sequence
aaagaaagtcctgaaattagagcggta

SEQ ID NO: 251653 - DNA, 27 bp, Artificial sequence
  SiRNA target sequence
aagaaagtcctgaaattagagcggtaa

SEQ ID NO: 251654 - DNA, 27 bp, Artificial sequence
  SiRNA target sequence
agaaagtcctgaaattagagcggtaaa

SEQ ID NO: 251655 - DNA, 27 bp, Artificial sequence
  SiRNA target sequence
gaaagtcctgaaattagagcggtaaaa

SEQ ID NO: 251656 - DNA, 27 bp, Artificial sequence
  SiRNA target sequence
aaagtcctgaaattagagcggtaaaaa

SEQ ID NO: 251657 - DNA, 27 bp, Artificial sequence
  SiRNA target sequence
aagtcctgaaattagagcggtaaaaaa

SEQ ID NO: 251658 - DNA, 27 bp, Artificial sequence
  SiRNA target sequence
agtcctgaaattagagcggtaaaaaat

SEQ ID NO: 251659 - DNA, 27 bp, Artificial sequence
  SiRNA target sequence
gtcctgaaattagagcggtaaaaaata

SEQ ID NO: 251660 - DNA, 27 bp, Artificial sequence
  SiRNA target sequence
tcctgaaattagagcggtaaaaaatat

SEQ ID NO: 251661 - DNA, 27 bp, Artificial sequence
  SiRNA target sequence
cctgaaattagagcggtaaaaaatata

SEQ ID NO: 251662 - DNA, 27 bp, Artificial sequence
  SiRNA target sequence
ctgaaattagagcggtaaaaaatatag

SEQ ID NO: 251663 - DNA, 27 bp, Artificial sequence
  SiRNA target sequence
tgaaattagagcggtaaaaaatatagc

SEQ ID NO: 251664 - DNA, 27 bp, Artificial sequence
  SiRNA target sequence
gaaattagagcggtaaaaaatatagca

SEQ ID NO: 251665 - DNA, 27 bp, Artificial sequence
  SiRNA target sequence
aaattagagcggtaaaaaatatagcag

SEQ ID NO: 251666 - DNA, 27 bp, Artificial sequence
  SiRNA target sequence
aattagagcggtaaaaaatatagcagc

SEQ ID NO: 251667 - DNA, 27 bp, Artificial sequence
  SiRNA target sequence
attagagcggtaaaaaatatagcagca

SEQ ID NO: 251668 - DNA, 27 bp, Artificial sequence
  SiRNA target sequence
ttagagcggtaaaaaatatagcagcaa

SEQ ID NO: 251669 - DNA, 27 bp, Artificial sequence
  SiRNA target sequence
tagagcggtaaaaaatatagcagcaat

SEQ ID NO: 251670 - DNA, 27 bp, Artificial sequence
  SiRNA target sequence
agagcggtaaaaaatatagcagcaata

SEQ ID NO: 251671 - DNA, 27 bp, Artificial sequence
  SiRNA target sequence
gagcggtaaaaaatatagcagcaatag

SEQ ID NO: 251672 - DNA, 27 bp, Artificial sequence
  SiRNA target sequence
agcggtaaaaaatatagcagcaatagg

SEQ ID NO: 251673 - DNA, 27 bp, Artificial sequence
  SiRNA target sequence
gcggtaaaaaatatagcagcaataggg

SEQ ID NO: 251674 - DNA, 27 bp, Artificial sequence
  SiRNA target sequence
cggtaaaaaatatagcagcaatagggg

SEQ ID NO: 251675 - DNA, 27 bp, Artificial sequence
  SiRNA target sequence
ggtaaaaaatatagcagcaatagggga

SEQ ID NO: 251676 - DNA, 27 bp, Artificial sequence
  SiRNA target sequence
gtaaaaaatatagcagcaataggggag

SEQ ID NO: 251677 - DNA, 27 bp, Artificial sequence
  SiRNA target sequence
taaaaaatatagcagcaataggggagg

SEQ ID NO: 251678 - DNA, 27 bp, Artificial sequence
  SiRNA target sequence
aaaaaatatagcagcaataggggaggc

SEQ ID NO: 251679 - DNA, 27 bp, Artificial sequence
  SiRNA target sequence
aaaaatatagcagcaataggggaggca

SEQ ID NO: 251680 - DNA, 27 bp, Artificial sequence
  SiRNA target sequence
aaaatatagcagcaataggggaggcaa

SEQ ID NO: 251681 - DNA, 27 bp, Artificial sequence
  SiRNA target sequence
aaatatagcagcaataggggaggcaat

SEQ ID NO: 251682 - DNA, 27 bp, Artificial sequence
  SiRNA target sequence
aatatagcagcaataggggaggcaata

SEQ ID NO: 251683 - DNA, 27 bp, Artificial sequence
  SiRNA target sequence
atatagcagcaataggggaggcaatag

SEQ ID NO: 251684 - DNA, 27 bp, Artificial sequence
  SiRNA target sequence
tatagcagcaataggggaggcaataga

SEQ ID NO: 251685 - DNA, 27 bp, Artificial sequence
  SiRNA target sequence
atagcagcaataggggaggcaatagat

SEQ ID NO: 251686 - DNA, 27 bp, Artificial sequence
  SiRNA target sequence
tagcagcaataggggaggcaatagata

SEQ ID NO: 251687 - DNA, 27 bp, Artificial sequence
  SiRNA target sequence
agcagcaataggggaggcaatagatag

SEQ ID NO: 251688 - DNA, 27 bp, Artificial sequence
  SiRNA target sequence
gcagcaataggggaggcaatagataga

SEQ ID NO: 251689 - DNA, 27 bp, Artificial sequence
  SiRNA target sequence
cagcaataggggaggcaatagatagat

SEQ ID NO: 251690 - DNA, 27 bp, Artificial sequence
  SiRNA target sequence
agcaataggggaggcaatagatagata

SEQ ID NO: 251691 - DNA, 27 bp, Artificial sequence
  SiRNA target sequence
gcaataggggaggcaatagatagataa

SEQ ID NO: 251692 - DNA, 27 bp, Artificial sequence
  SiRNA target sequence
caataggggaggcaatagatagataaa

SEQ ID NO: 251693 - DNA, 27 bp, Artificial sequence
  SiRNA target sequence
aataggggaggcaatagatagataaaa

SEQ ID NO: 251694 - DNA, 27 bp, Artificial sequence
  SiRNA target sequence
ataggggaggcaatagatagataaaag

SEQ ID NO: 251695 - DNA, 27 bp, Artificial sequence
  SiRNA target sequence
taggggaggcaatagatagataaaaga

SEQ ID NO: 251696 - DNA, 27 bp, Artificial sequence
  SiRNA target sequence
aggggaggcaatagatagataaaagat

SEQ ID NO: 251697 - DNA, 27 bp, Artificial sequence
  SiRNA target sequence
ggggaggcaatagatagataaaagatc

SEQ ID NO: 251698 - DNA, 27 bp, Artificial sequence
  SiRNA target sequence
gggaggcaatagatagataaaagatcc

SEQ ID NO: 251699 - DNA, 27 bp, Artificial sequence
  SiRNA target sequence
ggaggcaatagatagataaaagatcct

SEQ ID NO: 251700 - DNA, 27 bp, Artificial sequence
  SiRNA target sequence
gaggcaatagatagataaaagatcctt

SEQ ID NO: 251701 - DNA, 27 bp, Artificial sequence
  SiRNA target sequence
aggcaatagatagataaaagatccttg

SEQ ID NO: 251702 - DNA, 27 bp, Artificial sequence
  SiRNA target sequence
ggcaatagatagataaaagatccttga

SEQ ID NO: 251703 - DNA, 27 bp, Artificial sequence
  SiRNA target sequence
gcaatagatagataaaagatccttgat

SEQ ID NO: 251704 - DNA, 27 bp, Artificial sequence
  SiRNA target sequence
caatagatagataaaagatccttgatg

SEQ ID NO: 251705 - DNA, 27 bp, Artificial sequence
  SiRNA target sequence
aatagatagataaaagatccttgatgc

SEQ ID NO: 251706 - DNA, 27 bp, Artificial sequence
  SiRNA target sequence
atagatagataaaagatccttgatgca

SEQ ID NO: 251707 - DNA, 27 bp, Artificial sequence
  SiRNA target sequence
tagatagataaaagatccttgatgcaa

SEQ ID NO: 251708 - DNA, 27 bp, Artificial sequence
  SiRNA target sequence
agatagataaaagatccttgatgcaat

SEQ ID NO: 251709 - DNA, 27 bp, Artificial sequence
  SiRNA target sequence
gatagataaaagatccttgatgcaatg

SEQ ID NO: 251710 - DNA, 27 bp, Artificial sequence
  SiRNA target sequence
atagataaaagatccttgatgcaatgc

SEQ ID NO: 251711 - DNA, 27 bp, Artificial sequence
  SiRNA target sequence
tagataaaagatccttgatgcaatgcg

SEQ ID NO: 251712 - DNA, 27 bp, Artificial sequence
  SiRNA target sequence
agataaaagatccttgatgcaatgcga

SEQ ID NO: 251713 - DNA, 27 bp, Artificial sequence
  SiRNA target sequence
gataaaagatccttgatgcaatgcgat

SEQ ID NO: 251714 - DNA, 27 bp, Artificial sequence
  SiRNA target sequence
ataaaagatccttgatgcaatgcgatt

SEQ ID NO: 251715 - DNA, 27 bp, Artificial sequence
  SiRNA target sequence
taaaagatccttgatgcaatgcgattt

SEQ ID NO: 251716 - DNA, 27 bp, Artificial sequence
  SiRNA target sequence
aaaagatccttgatgcaatgcgatttc

SEQ ID NO: 251717 - DNA, 27 bp, Artificial sequence
  SiRNA target sequence
aaagatccttgatgcaatgcgatttcc

SEQ ID NO: 251718 - DNA, 27 bp, Artificial sequence
  SiRNA target sequence
aagatccttgatgcaatgcgatttcca

SEQ ID NO: 251719 - DNA, 27 bp, Artificial sequence
  SiRNA target sequence
agatccttgatgcaatgcgatttccac

SEQ ID NO: 251720 - DNA, 27 bp, Artificial sequence
  SiRNA target sequence
gatccttgatgcaatgcgatttccacg

SEQ ID NO: 251721 - DNA, 27 bp, Artificial sequence
  SiRNA target sequence
atccttgatgcaatgcgatttccacgg

SEQ ID NO: 251722 - DNA, 27 bp, Artificial sequence
  SiRNA target sequence
tccttgatgcaatgcgatttccacgga

SEQ ID NO: 251723 - DNA, 27 bp, Artificial sequence
  SiRNA target sequence
ccttgatgcaatgcgatttccacggat

SEQ ID NO: 251724 - DNA, 27 bp, Artificial sequence
  SiRNA target sequence
cttgatgcaatgcgatttccacggatt

SEQ ID NO: 251725 - DNA, 27 bp, Artificial sequence
  SiRNA target sequence
ttgatgcaatgcgatttccacggatta

SEQ ID NO: 251726 - DNA, 27 bp, Artificial sequence
  SiRNA target sequence
tgatgcaatgcgatttccacggattac

SEQ ID NO: 251727 - DNA, 27 bp, Artificial sequence
  SiRNA target sequence
gatgcaatgcgatttccacggattaca

SEQ ID NO: 251728 - DNA, 27 bp, Artificial sequence
  SiRNA target sequence
atgcaatgcgatttccacggattacaa

SEQ ID NO: 251729 - DNA, 27 bp, Artificial sequence
  SiRNA target sequence
tgcaatgcgatttccacggattacaaa

SEQ ID NO: 251730 - DNA, 27 bp, Artificial sequence
  SiRNA target sequence
gcaatgcgatttccacggattacaaag

SEQ ID NO: 251731 - DNA, 27 bp, Artificial sequence
  SiRNA target sequence
caatgcgatttccacggattacaaagt

SEQ ID NO: 251732 - DNA, 27 bp, Artificial sequence
  SiRNA target sequence
aatgcgatttccacggattacaaagtt

SEQ ID NO: 251733 - DNA, 27 bp, Artificial sequence
  SiRNA target sequence
atgcgatttccacggattacaaagtta

SEQ ID NO: 251734 - DNA, 27 bp, Artificial sequence
  SiRNA target sequence
tgcgatttccacggattacaaagttat

SEQ ID NO: 251735 - DNA, 27 bp, Artificial sequence
  SiRNA target sequence
gcgatttccacggattacaaagttata

SEQ ID NO: 251736 - DNA, 27 bp, Artificial sequence
  SiRNA target sequence
cgatttccacggattacaaagttataa

SEQ ID NO: 251737 - DNA, 27 bp, Artificial sequence
  SiRNA target sequence
gatttccacggattacaaagttataaa

SEQ ID NO: 251738 - DNA, 27 bp, Artificial sequence
  SiRNA target sequence
atttccacggattacaaagttataaaa

SEQ ID NO: 251739 - DNA, 27 bp, Artificial sequence
  SiRNA target sequence
tttccacggattacaaagttataaaat

SEQ ID NO: 251740 - DNA, 27 bp, Artificial sequence
  SiRNA target sequence
ttccacggattacaaagttataaaata

SEQ ID NO: 251741 - DNA, 27 bp, Artificial sequence
  SiRNA target sequence
tccacggattacaaagttataaaataa

SEQ ID NO: 251742 - DNA, 27 bp, Artificial sequence
  SiRNA target sequence
ccacggattacaaagttataaaataat

SEQ ID NO: 251743 - DNA, 27 bp, Artificial sequence
  SiRNA target sequence
cacggattacaaagttataaaataatg

SEQ ID NO: 251744 - DNA, 27 bp, Artificial sequence
  SiRNA target sequence
acggattacaaagttataaaataatga

SEQ ID NO: 251745 - DNA, 27 bp, Artificial sequence
  SiRNA target sequence
cggattacaaagttataaaataatgat

SEQ ID NO: 251746 - DNA, 27 bp, Artificial sequence
  SiRNA target sequence
ggattacaaagttataaaataatgata

SEQ ID NO: 251747 - DNA, 27 bp, Artificial sequence
  SiRNA target sequence
gattacaaagttataaaataatgatac

SEQ ID NO: 251748 - DNA, 27 bp, Artificial sequence
  SiRNA target sequence
attacaaagttataaaataatgataca

SEQ ID NO: 251749 - DNA, 27 bp, Artificial sequence
  SiRNA target sequence
ttacaaagttataaaataatgatacag

SEQ ID NO: 251750 - DNA, 27 bp, Artificial sequence
  SiRNA target sequence
tacaaagttataaaataatgatacagc

SEQ ID NO: 251751 - DNA, 27 bp, Artificial sequence
  SiRNA target sequence
acaaagttataaaataatgatacagca

SEQ ID NO: 251752 - DNA, 27 bp, Artificial sequence
  SiRNA target sequence
caaagttataaaataatgatacagcac

SEQ ID NO: 251753 - DNA, 27 bp, Artificial sequence
  SiRNA target sequence
aaagttataaaataatgatacagcact

SEQ ID NO: 251754 - DNA, 27 bp, Artificial sequence
  SiRNA target sequence
aagttataaaataatgatacagcacta

SEQ ID NO: 251755 - DNA, 27 bp, Artificial sequence
  SiRNA target sequence
agttataaaataatgatacagcactaa

SEQ ID NO: 251756 - DNA, 27 bp, Artificial sequence
  SiRNA target sequence
gttataaaataatgatacagcactaat

SEQ ID NO: 251757 - DNA, 27 bp, Artificial sequence
  SiRNA target sequence
ttataaaataatgatacagcactaatc

SEQ ID NO: 251758 - DNA, 27 bp, Artificial sequence
  SiRNA target sequence
tataaaataatgatacagcactaatcg

SEQ ID NO: 251759 - DNA, 27 bp, Artificial sequence
  SiRNA target sequence
ataaaataatgatacagcactaatcgt

SEQ ID NO: 251760 - DNA, 27 bp, Artificial sequence
  SiRNA target sequence
taaaataatgatacagcactaatcgtt

SEQ ID NO: 251761 - DNA, 27 bp, Artificial sequence
  SiRNA target sequence
aaaataatgatacagcactaatcgtta

SEQ ID NO: 251762 - DNA, 27 bp, Artificial sequence
  SiRNA target sequence
aaataatgatacagcactaatcgttaa

SEQ ID NO: 251763 - DNA, 27 bp, Artificial sequence
  SiRNA target sequence
aataatgatacagcactaatcgttaag

SEQ ID NO: 251764 - DNA, 27 bp, Artificial sequence
  SiRNA target sequence
ataatgatacagcactaatcgttaagg

SEQ ID NO: 251765 - DNA, 27 bp, Artificial sequence
  SiRNA target sequence
taatgatacagcactaatcgttaagga

SEQ ID NO: 251766 - DNA, 27 bp, Artificial sequence
  SiRNA target sequence
aatgatacagcactaatcgttaaggaa

SEQ ID NO: 251767 - DNA, 27 bp, Artificial sequence
  SiRNA target sequence
atgatacagcactaatcgttaaggaag

SEQ ID NO: 251768 - DNA, 27 bp, Artificial sequence
  SiRNA target sequence
tgatacagcactaatcgttaaggaagt

SEQ ID NO: 251769 - DNA, 27 bp, Artificial sequence
  SiRNA target sequence
gatacagcactaatcgttaaggaagtt

SEQ ID NO: 251770 - DNA, 27 bp, Artificial sequence
  SiRNA target sequence
atacagcactaatcgttaaggaagttg

SEQ ID NO: 251771 - DNA, 27 bp, Artificial sequence
  SiRNA target sequence
tacagcactaatcgttaaggaagttgt

SEQ ID NO: 251772 - DNA, 27 bp, Artificial sequence
  SiRNA target sequence
acagcactaatcgttaaggaagttgtt

SEQ ID NO: 251773 - DNA, 27 bp, Artificial sequence
  SiRNA target sequence
cagcactaatcgttaaggaagttgtta

SEQ ID NO: 251774 - DNA, 27 bp, Artificial sequence
  SiRNA target sequence
agcactaatcgttaaggaagttgttac

SEQ ID NO: 251775 - DNA, 27 bp, Artificial sequence
  SiRNA target sequence
gcactaatcgttaaggaagttgttact

SEQ ID NO: 251776 - DNA, 27 bp, Artificial sequence
  SiRNA target sequence
cactaatcgttaaggaagttgttacta

SEQ ID NO: 251777 - DNA, 27 bp, Artificial sequence
  SiRNA target sequence
actaatcgttaaggaagttgttactaa

SEQ ID NO: 251778 - DNA, 27 bp, Artificial sequence
  SiRNA target sequence
ctaatcgttaaggaagttgttactaaa

SEQ ID NO: 251779 - DNA, 27 bp, Artificial sequence
  SiRNA target sequence
taatcgttaaggaagttgttactaaat

SEQ ID NO: 251780 - DNA, 27 bp, Artificial sequence
  SiRNA target sequence
aatcgttaaggaagttgttactaaata

SEQ ID NO: 251781 - DNA, 27 bp, Artificial sequence
  SiRNA target sequence
atcgttaaggaagttgttactaaatat

SEQ ID NO: 251782 - DNA, 27 bp, Artificial sequence
  SiRNA target sequence
tcgttaaggaagttgttactaaatatt

SEQ ID NO: 251783 - DNA, 27 bp, Artificial sequence
  SiRNA target sequence
cgttaaggaagttgttactaaatattt

SEQ ID NO: 251784 - DNA, 27 bp, Artificial sequence
  SiRNA target sequence
gttaaggaagttgttactaaatatttt

SEQ ID NO: 251785 - DNA, 27 bp, Artificial sequence
  SiRNA target sequence
ttaaggaagttgttactaaatattttt

SEQ ID NO: 251786 - DNA, 27 bp, Artificial sequence
  SiRNA target sequence
taaggaagttgttactaaatatttttg

SEQ ID NO: 251787 - DNA, 27 bp, Artificial sequence
  SiRNA target sequence
aaggaagttgttactaaatatttttga

SEQ ID NO: 251788 - DNA, 27 bp, Artificial sequence
  SiRNA target sequence
aggaagttgttactaaatatttttgag

SEQ ID NO: 251789 - DNA, 27 bp, Artificial sequence
  SiRNA target sequence
ggaagttgttactaaatatttttgaga

SEQ ID NO: 251790 - DNA, 27 bp, Artificial sequence
  SiRNA target sequence
gaagttgttactaaatatttttgagaa

SEQ ID NO: 251791 - DNA, 27 bp, Artificial sequence
  SiRNA target sequence
aagttgttactaaatatttttgagaat

SEQ ID NO: 251792 - DNA, 27 bp, Artificial sequence
  SiRNA target sequence
agttgttactaaatatttttgagaata

SEQ ID NO: 251793 - DNA, 27 bp, Artificial sequence
  SiRNA target sequence
gttgttactaaatatttttgagaataa

SEQ ID NO: 251794 - DNA, 27 bp, Artificial sequence
  SiRNA target sequence
ttgttactaaatatttttgagaataat

SEQ ID NO: 251795 - DNA, 27 bp, Artificial sequence
  SiRNA target sequence
tgttactaaatatttttgagaataatc

SEQ ID NO: 251796 - DNA, 27 bp, Artificial sequence
  SiRNA target sequence
gttactaaatatttttgagaataatct

SEQ ID NO: 251797 - DNA, 27 bp, Artificial sequence
  SiRNA target sequence
ttactaaatatttttgagaataatctt

SEQ ID NO: 251798 - DNA, 27 bp, Artificial sequence
  SiRNA target sequence
tactaaatatttttgagaataatcttt

SEQ ID NO: 251799 - DNA, 27 bp, Artificial sequence
  SiRNA target sequence
actaaatatttttgagaataatctttc

SEQ ID NO: 251800 - DNA, 27 bp, Artificial sequence
  SiRNA target sequence
ctaaatatttttgagaataatctttcg

SEQ ID NO: 251801 - DNA, 27 bp, Artificial sequence
  SiRNA target sequence
taaatatttttgagaataatctttcgg

SEQ ID NO: 251802 - DNA, 27 bp, Artificial sequence
  SiRNA target sequence
aaatatttttgagaataatctttcgga

SEQ ID NO: 251803 - DNA, 27 bp, Artificial sequence
  SiRNA target sequence
aatatttttgagaataatctttcggag

SEQ ID NO: 251804 - DNA, 27 bp, Artificial sequence
  SiRNA target sequence
atatttttgagaataatctttcggagg

SEQ ID NO: 251805 - DNA, 27 bp, Artificial sequence
  SiRNA target sequence
tatttttgagaataatctttcggaggc

SEQ ID NO: 251806 - DNA, 27 bp, Artificial sequence
  SiRNA target sequence
atttttgagaataatctttcggaggca

SEQ ID NO: 251807 - DNA, 27 bp, Artificial sequence
  SiRNA target sequence
tttttgagaataatctttcggaggcat

SEQ ID NO: 251808 - DNA, 27 bp, Artificial sequence
  SiRNA target sequence
ttttgagaataatctttcggaggcata

SEQ ID NO: 251809 - DNA, 27 bp, Artificial sequence
  SiRNA target sequence
tttgagaataatctttcggaggcatat

SEQ ID NO: 251810 - DNA, 27 bp, Artificial sequence
  SiRNA target sequence
ttgagaataatctttcggaggcatatt

SEQ ID NO: 251811 - DNA, 27 bp, Artificial sequence
  SiRNA target sequence
tgagaataatctttcggaggcatatta

SEQ ID NO: 251812 - DNA, 27 bp, Artificial sequence
  SiRNA target sequence
gagaataatctttcggaggcatattat

SEQ ID NO: 251813 - DNA, 27 bp, Artificial sequence
  SiRNA target sequence
agaataatctttcggaggcatattatt

SEQ ID NO: 251814 - DNA, 27 bp, Artificial sequence
  SiRNA target sequence
gaataatctttcggaggcatattatta

SEQ ID NO: 251815 - DNA, 27 bp, Artificial sequence
  SiRNA target sequence
aataatctttcggaggcatattattaa

SEQ ID NO: 251816 - DNA, 27 bp, Artificial sequence
  SiRNA target sequence
ataatctttcggaggcatattattaat

SEQ ID NO: 251817 - DNA, 27 bp, Artificial sequence
  SiRNA target sequence
taatctttcggaggcatattattaatt

SEQ ID NO: 251818 - DNA, 27 bp, Artificial sequence
  SiRNA target sequence
aatctttcggaggcatattattaattc

SEQ ID NO: 251819 - DNA, 27 bp, Artificial sequence
  SiRNA target sequence
atctttcggaggcatattattaattct

SEQ ID NO: 251820 - DNA, 27 bp, Artificial sequence
  SiRNA target sequence
tctttcggaggcatattattaattctg

SEQ ID NO: 251821 - DNA, 27 bp, Artificial sequence
  SiRNA target sequence
ctttcggaggcatattattaattctgc

SEQ ID NO: 251822 - DNA, 27 bp, Artificial sequence
  SiRNA target sequence
tttcggaggcatattattaattctgct

SEQ ID NO: 251823 - DNA, 27 bp, Artificial sequence
  SiRNA target sequence
ttcggaggcatattattaattctgctt

SEQ ID NO: 251824 - DNA, 27 bp, Artificial sequence
  SiRNA target sequence
tcggaggcatattattaattctgcttc

SEQ ID NO: 251825 - DNA, 27 bp, Artificial sequence
  SiRNA target sequence
cggaggcatattattaattctgcttcc

SEQ ID NO: 251826 - DNA, 27 bp, Artificial sequence
  SiRNA target sequence
ggaggcatattattaattctgcttccc

SEQ ID NO: 251827 - DNA, 27 bp, Artificial sequence
  SiRNA target sequence
gaggcatattattaattctgcttcccg

SEQ ID NO: 251828 - DNA, 27 bp, Artificial sequence
  SiRNA target sequence
aggcatattattaattctgcttcccgt

SEQ ID NO: 251829 - DNA, 27 bp, Artificial sequence
  SiRNA target sequence
ggcatattattaattctgcttcccgta

SEQ ID NO: 251830 - DNA, 27 bp, Artificial sequence
  SiRNA target sequence
gcatattattaattctgcttcccgtag

SEQ ID NO: 251831 - DNA, 27 bp, Artificial sequence
  SiRNA target sequence
catattattaattctgcttcccgtaga

SEQ ID NO: 251832 - DNA, 27 bp, Artificial sequence
  SiRNA target sequence
atattattaattctgcttcccgtagat

SEQ ID NO: 251833 - DNA, 27 bp, Artificial sequence
  SiRNA target sequence
tattattaattctgcttcccgtagata

SEQ ID NO: 251834 - DNA, 27 bp, Artificial sequence
  SiRNA target sequence
attattaattctgcttcccgtagataa

SEQ ID NO: 251835 - DNA, 27 bp, Artificial sequence
  SiRNA target sequence
ttattaattctgcttcccgtagataaa

SEQ ID NO: 251836 - DNA, 27 bp, Artificial sequence
  SiRNA target sequence
tattaattctgcttcccgtagataaag

SEQ ID NO: 251837 - DNA, 27 bp, Artificial sequence
  SiRNA target sequence
attaattctgcttcccgtagataaaga

SEQ ID NO: 251838 - DNA, 27 bp, Artificial sequence
  SiRNA target sequence
ttaattctgcttcccgtagataaagaa

SEQ ID NO: 251839 - DNA, 27 bp, Artificial sequence
  SiRNA target sequence
taattctgcttcccgtagataaagaat

SEQ ID NO: 251840 - DNA, 27 bp, Artificial sequence
  SiRNA target sequence
aattctgcttcccgtagataaagaatt

SEQ ID NO: 251841 - DNA, 27 bp, Artificial sequence
  SiRNA target sequence
attctgcttcccgtagataaagaattt

SEQ ID NO: 251842 - DNA, 27 bp, Artificial sequence
  SiRNA target sequence
ttctgcttcccgtagataaagaatttt

SEQ ID NO: 251843 - DNA, 27 bp, Artificial sequence
  SiRNA target sequence
tctgcttcccgtagataaagaattttt

SEQ ID NO: 251844 - DNA, 27 bp, Artificial sequence
  SiRNA target sequence
ctgcttcccgtagataaagaatttttt

SEQ ID NO: 251845 - DNA, 27 bp, Artificial sequence
  SiRNA target sequence
tgcttcccgtagataaagaatttttta

SEQ ID NO: 251846 - DNA, 27 bp, Artificial sequence
  SiRNA target sequence
gcttcccgtagataaagaattttttaa

SEQ ID NO: 251847 - DNA, 27 bp, Artificial sequence
  SiRNA target sequence
cttcccgtagataaagaattttttaag

SEQ ID NO: 251848 - DNA, 27 bp, Artificial sequence
  SiRNA target sequence
ttcccgtagataaagaattttttaagg

SEQ ID NO: 251849 - DNA, 27 bp, Artificial sequence
  SiRNA target sequence
tcccgtagataaagaattttttaagga

SEQ ID NO: 251850 - DNA, 27 bp, Artificial sequence
  SiRNA target sequence
cccgtagataaagaattttttaaggac

SEQ ID NO: 251851 - DNA, 27 bp, Artificial sequence
  SiRNA target sequence
ccgtagataaagaattttttaaggaca

SEQ ID NO: 251852 - DNA, 27 bp, Artificial sequence
  SiRNA target sequence
cgtagataaagaattttttaaggacat

SEQ ID NO: 251853 - DNA, 27 bp, Artificial sequence
  SiRNA target sequence
gtagataaagaattttttaaggacata

SEQ ID NO: 251854 - DNA, 27 bp, Artificial sequence
  SiRNA target sequence
tagataaagaattttttaaggacatat

SEQ ID NO: 251855 - DNA, 27 bp, Artificial sequence
  SiRNA target sequence
agataaagaattttttaaggacatatc

SEQ ID NO: 251856 - DNA, 27 bp, Artificial sequence
  SiRNA target sequence
gataaagaattttttaaggacatatca

SEQ ID NO: 251857 - DNA, 27 bp, Artificial sequence
  SiRNA target sequence
ataaagaattttttaaggacatatcaa

SEQ ID NO: 251858 - DNA, 27 bp, Artificial sequence
  SiRNA target sequence
taaagaattttttaaggacatatcaat

SEQ ID NO: 251859 - DNA, 27 bp, Artificial sequence
  SiRNA target sequence
aaagaattttttaaggacatatcaata

SEQ ID NO: 251860 - DNA, 27 bp, Artificial sequence
  SiRNA target sequence
aagaattttttaaggacatatcaataa

SEQ ID NO: 251861 - DNA, 27 bp, Artificial sequence
  SiRNA target sequence
agaattttttaaggacatatcaataaa

SEQ ID NO: 251862 - DNA, 27 bp, Artificial sequence
  SiRNA target sequence
gaattttttaaggacatatcaataaat

SEQ ID NO: 251863 - DNA, 27 bp, Artificial sequence
  SiRNA target sequence
aattttttaaggacatatcaataaatc

SEQ ID NO: 251864 - DNA, 27 bp, Artificial sequence
  SiRNA target sequence
attttttaaggacatatcaataaatcc

SEQ ID NO: 251865 - DNA, 27 bp, Artificial sequence
  SiRNA target sequence
ttttttaaggacatatcaataaatcct

SEQ ID NO: 251866 - DNA, 27 bp, Artificial sequence
  SiRNA target sequence
tttttaaggacatatcaataaatcctg

SEQ ID NO: 251867 - DNA, 27 bp, Artificial sequence
  SiRNA target sequence
ttttaaggacatatcaataaatcctgc

SEQ ID NO: 251868 - DNA, 27 bp, Artificial sequence
  SiRNA target sequence
tttaaggacatatcaataaatcctgca

SEQ ID NO: 251869 - DNA, 27 bp, Artificial sequence
  SiRNA target sequence
ttaaggacatatcaataaatcctgcat

SEQ ID NO: 251870 - DNA, 27 bp, Artificial sequence
  SiRNA target sequence
taaggacatatcaataaatcctgcatt

SEQ ID NO: 251871 - DNA, 27 bp, Artificial sequence
  SiRNA target sequence
aaggacatatcaataaatcctgcatta

SEQ ID NO: 251872 - DNA, 27 bp, Artificial sequence
  SiRNA target sequence
aggacatatcaataaatcctgcattaa

SEQ ID NO: 251873 - DNA, 27 bp, Artificial sequence
  SiRNA target sequence
ggacatatcaataaatcctgcattaat

SEQ ID NO: 251874 - DNA, 27 bp, Artificial sequence
  SiRNA target sequence
gacatatcaataaatcctgcattaata

SEQ ID NO: 251875 - DNA, 27 bp, Artificial sequence
  SiRNA target sequence
acatatcaataaatcctgcattaatag

SEQ ID NO: 251876 - DNA, 27 bp, Artificial sequence
  SiRNA target sequence
catatcaataaatcctgcattaatagc

SEQ ID NO: 251877 - DNA, 27 bp, Artificial sequence
  SiRNA target sequence
atatcaataaatcctgcattaatagca

SEQ ID NO: 251878 - DNA, 27 bp, Artificial sequence
  SiRNA target sequence
tatcaataaatcctgcattaatagcat

SEQ ID NO: 251879 - DNA, 27 bp, Artificial sequence
  SiRNA target sequence
atcaataaatcctgcattaatagcata

SEQ ID NO: 251880 - DNA, 27 bp, Artificial sequence
  SiRNA target sequence
tcaataaatcctgcattaatagcatag

SEQ ID NO: 251881 - DNA, 27 bp, Artificial sequence
  SiRNA target sequence
caataaatcctgcattaatagcataga

SEQ ID NO: 251882 - DNA, 27 bp, Artificial sequence
  SiRNA target sequence
aataaatcctgcattaatagcatagat

SEQ ID NO: 251883 - DNA, 27 bp, Artificial sequence
  SiRNA target sequence
ataaatcctgcattaatagcatagatt

SEQ ID NO: 251884 - DNA, 27 bp, Artificial sequence
  SiRNA target sequence
taaatcctgcattaatagcatagatta

SEQ ID NO: 251885 - DNA, 27 bp, Artificial sequence
  SiRNA target sequence
aaatcctgcattaatagcatagattaa

SEQ ID NO: 251886 - DNA, 27 bp, Artificial sequence
  SiRNA target sequence
aatcctgcattaatagcatagattaat

SEQ ID NO: 251887 - DNA, 27 bp, Artificial sequence
  SiRNA target sequence
atcctgcattaatagcatagattaatg

SEQ ID NO: 251888 - DNA, 27 bp, Artificial sequence
  SiRNA target sequence
tcctgcattaatagcatagattaatgc

SEQ ID NO: 251889 - DNA, 27 bp, Artificial sequence
  SiRNA target sequence
cctgcattaatagcatagattaatgcc

SEQ ID NO: 251890 - DNA, 27 bp, Artificial sequence
  SiRNA target sequence
ctgcattaatagcatagattaatgccg

SEQ ID NO: 251891 - DNA, 27 bp, Artificial sequence
  SiRNA target sequence
tgcattaatagcatagattaatgccgc

SEQ ID NO: 251892 - DNA, 27 bp, Artificial sequence
  SiRNA target sequence
gcattaatagcatagattaatgccgct

SEQ ID NO: 251893 - DNA, 27 bp, Artificial sequence
  SiRNA target sequence
cattaatagcatagattaatgccgctg

SEQ ID NO: 251894 - DNA, 27 bp, Artificial sequence
  SiRNA target sequence
attaatagcatagattaatgccgctgc

SEQ ID NO: 251895 - DNA, 27 bp, Artificial sequence
  SiRNA target sequence
ttaatagcatagattaatgccgctgca

SEQ ID NO: 251896 - DNA, 27 bp, Artificial sequence
  SiRNA target sequence
taatagcatagattaatgccgctgcac

SEQ ID NO: 251897 - DNA, 27 bp, Artificial sequence
  SiRNA target sequence
aatagcatagattaatgccgctgcaca

SEQ ID NO: 251898 - DNA, 27 bp, Artificial sequence
  SiRNA target sequence
atagcatagattaatgccgctgcacac

SEQ ID NO: 251899 - DNA, 27 bp, Artificial sequence
  SiRNA target sequence
tagcatagattaatgccgctgcacaca

SEQ ID NO: 251900 - DNA, 27 bp, Artificial sequence
  SiRNA target sequence
agcatagattaatgccgctgcacacat

SEQ ID NO: 251901 - DNA, 27 bp, Artificial sequence
  SiRNA target sequence
gcatagattaatgccgctgcacacata

SEQ ID NO: 251902 - DNA, 27 bp, Artificial sequence
  SiRNA target sequence
catagattaatgccgctgcacacatat

SEQ ID NO: 251903 - DNA, 27 bp, Artificial sequence
  SiRNA target sequence
atagattaatgccgctgcacacatatt

SEQ ID NO: 251904 - DNA, 27 bp, Artificial sequence
  SiRNA target sequence
tagattaatgccgctgcacacatattt

SEQ ID NO: 251905 - DNA, 27 bp, Artificial sequence
  SiRNA target sequence
agattaatgccgctgcacacatatttc

SEQ ID NO: 251906 - DNA, 27 bp, Artificial sequence
  SiRNA target sequence
gattaatgccgctgcacacatatttct

SEQ ID NO: 251907 - DNA, 27 bp, Artificial sequence
  SiRNA target sequence
attaatgccgctgcacacatatttctt

SEQ ID NO: 251908 - DNA, 27 bp, Artificial sequence
  SiRNA target sequence
ttaatgccgctgcacacatatttctta

SEQ ID NO: 251909 - DNA, 27 bp, Artificial sequence
  SiRNA target sequence
taatgccgctgcacacatatttcttaa

SEQ ID NO: 251910 - DNA, 27 bp, Artificial sequence
  SiRNA target sequence
aatgccgctgcacacatatttcttaaa

SEQ ID NO: 251911 - DNA, 27 bp, Artificial sequence
  SiRNA target sequence
atgccgctgcacacatatttcttaaaa

SEQ ID NO: 251912 - DNA, 27 bp, Artificial sequence
  SiRNA target sequence
tgccgctgcacacatatttcttaaaaa

SEQ ID NO: 251913 - DNA, 27 bp, Artificial sequence
  SiRNA target sequence
gccgctgcacacatatttcttaaaaat

SEQ ID NO: 251914 - DNA, 27 bp, Artificial sequence
  SiRNA target sequence
ccgctgcacacatatttcttaaaaatt

SEQ ID NO: 251915 - DNA, 27 bp, Artificial sequence
  SiRNA target sequence
cgctgcacacatatttcttaaaaattt

SEQ ID NO: 251916 - DNA, 27 bp, Artificial sequence
  SiRNA target sequence
gctgcacacatatttcttaaaaatttg

SEQ ID NO: 251917 - DNA, 27 bp, Artificial sequence
  SiRNA target sequence
ctgcacacatatttcttaaaaatttgg

SEQ ID NO: 251918 - DNA, 27 bp, Artificial sequence
  SiRNA target sequence
tgcacacatatttcttaaaaatttgga

SEQ ID NO: 251919 - DNA, 27 bp, Artificial sequence
  SiRNA target sequence
gcacacatatttcttaaaaatttggat

SEQ ID NO: 251920 - DNA, 27 bp, Artificial sequence
  SiRNA target sequence
cacacatatttcttaaaaatttggatt

SEQ ID NO: 251921 - DNA, 27 bp, Artificial sequence
  SiRNA target sequence
acacatatttcttaaaaatttggattg

SEQ ID NO: 251922 - DNA, 27 bp, Artificial sequence
  SiRNA target sequence
cacatatttcttaaaaatttggattgt

SEQ ID NO: 251923 - DNA, 27 bp, Artificial sequence
  SiRNA target sequence
acatatttcttaaaaatttggattgta

SEQ ID NO: 251924 - DNA, 27 bp, Artificial sequence
  SiRNA target sequence
catatttcttaaaaatttggattgtaa

SEQ ID NO: 251925 - DNA, 27 bp, Artificial sequence
  SiRNA target sequence
atatttcttaaaaatttggattgtaaa

SEQ ID NO: 251926 - DNA, 27 bp, Artificial sequence
  SiRNA target sequence
tatttcttaaaaatttggattgtaaaa

SEQ ID NO: 251927 - DNA, 27 bp, Artificial sequence
  SiRNA target sequence
atttcttaaaaatttggattgtaaaag

SEQ ID NO: 251928 - DNA, 27 bp, Artificial sequence
  SiRNA target sequence
tttcttaaaaatttggattgtaaaaga

SEQ ID NO: 251929 - DNA, 27 bp, Artificial sequence
  SiRNA target sequence
ttcttaaaaatttggattgtaaaagat

SEQ ID NO: 251930 - DNA, 27 bp, Artificial sequence
  SiRNA target sequence
tcttaaaaatttggattgtaaaagatc

SEQ ID NO: 251931 - DNA, 27 bp, Artificial sequence
  SiRNA target sequence
cttaaaaatttggattgtaaaagatca

SEQ ID NO: 251932 - DNA, 27 bp, Artificial sequence
  SiRNA target sequence
ttaaaaatttggattgtaaaagatcaa

SEQ ID NO: 251933 - DNA, 27 bp, Artificial sequence
  SiRNA target sequence
taaaaatttggattgtaaaagatcaaa

SEQ ID NO: 251934 - DNA, 27 bp, Artificial sequence
  SiRNA target sequence
aaaaatttggattgtaaaagatcaaac

SEQ ID NO: 251935 - DNA, 27 bp, Artificial sequence
  SiRNA target sequence
aaaatttggattgtaaaagatcaaacg

SEQ ID NO: 251936 - DNA, 27 bp, Artificial sequence
  SiRNA target sequence
aaatttggattgtaaaagatcaaacga

SEQ ID NO: 251937 - DNA, 27 bp, Artificial sequence
  SiRNA target sequence
aatttggattgtaaaagatcaaacgag

SEQ ID NO: 251938 - DNA, 27 bp, Artificial sequence
  SiRNA target sequence
atttggattgtaaaagatcaaacgagg

SEQ ID NO: 251939 - DNA, 27 bp, Artificial sequence
  SiRNA target sequence
tttggattgtaaaagatcaaacgagga

SEQ ID NO: 251940 - DNA, 27 bp, Artificial sequence
  SiRNA target sequence
ttggattgtaaaagatcaaacgaggat

SEQ ID NO: 251941 - DNA, 27 bp, Artificial sequence
  SiRNA target sequence
tggattgtaaaagatcaaacgaggatg

SEQ ID NO: 251942 - DNA, 27 bp, Artificial sequence
  SiRNA target sequence
ggattgtaaaagatcaaacgaggatgt

SEQ ID NO: 251943 - DNA, 27 bp, Artificial sequence
  SiRNA target sequence
gattgtaaaagatcaaacgaggatgtc

SEQ ID NO: 251944 - DNA, 27 bp, Artificial sequence
  SiRNA target sequence
attgtaaaagatcaaacgaggatgtcg

SEQ ID NO: 251945 - DNA, 27 bp, Artificial sequence
  SiRNA target sequence
ttgtaaaagatcaaacgaggatgtcgt

SEQ ID NO: 251946 - DNA, 27 bp, Artificial sequence
  SiRNA target sequence
tgtaaaagatcaaacgaggatgtcgtt

SEQ ID NO: 251947 - DNA, 27 bp, Artificial sequence
  SiRNA target sequence
gtaaaagatcaaacgaggatgtcgttt

SEQ ID NO: 251948 - DNA, 27 bp, Artificial sequence
  SiRNA target sequence
taaaagatcaaacgaggatgtcgtttt

SEQ ID NO: 251949 - DNA, 27 bp, Artificial sequence
  SiRNA target sequence
aaaagatcaaacgaggatgtcgttttg

SEQ ID NO: 251950 - DNA, 27 bp, Artificial sequence
  SiRNA target sequence
aaagatcaaacgaggatgtcgttttgt

SEQ ID NO: 251951 - DNA, 27 bp, Artificial sequence
  SiRNA target sequence
aagatcaaacgaggatgtcgttttgtc

SEQ ID NO: 251952 - DNA, 27 bp, Artificial sequence
  SiRNA target sequence
agatcaaacgaggatgtcgttttgtct

SEQ ID NO: 251953 - DNA, 27 bp, Artificial sequence
  SiRNA target sequence
gatcaaacgaggatgtcgttttgtctt

SEQ ID NO: 251954 - DNA, 27 bp, Artificial sequence
  SiRNA target sequence
atcaaacgaggatgtcgttttgtcttc

SEQ ID NO: 251955 - DNA, 27 bp, Artificial sequence
  SiRNA target sequence
tcaaacgaggatgtcgttttgtcttct

SEQ ID NO: 251956 - DNA, 27 bp, Artificial sequence
  SiRNA target sequence
caaacgaggatgtcgttttgtcttctt

SEQ ID NO: 251957 - DNA, 27 bp, Artificial sequence
  SiRNA target sequence
aaacgaggatgtcgttttgtcttcttc

SEQ ID NO: 251958 - DNA, 27 bp, Artificial sequence
  SiRNA target sequence
aacgaggatgtcgttttgtcttcttct

SEQ ID NO: 251959 - DNA, 27 bp, Artificial sequence
  SiRNA target sequence
acgaggatgtcgttttgtcttcttctt

SEQ ID NO: 251960 - DNA, 27 bp, Artificial sequence
  SiRNA target sequence
cgaggatgtcgttttgtcttcttcttt

SEQ ID NO: 251961 - DNA, 27 bp, Artificial sequence
  SiRNA target sequence
gaggatgtcgttttgtcttcttcttta

SEQ ID NO: 251962 - DNA, 27 bp, Artificial sequence
  SiRNA target sequence
aggatgtcgttttgtcttcttctttat

SEQ ID NO: 251963 - DNA, 27 bp, Artificial sequence
  SiRNA target sequence
ggatgtcgttttgtcttcttctttatt

SEQ ID NO: 251964 - DNA, 27 bp, Artificial sequence
  SiRNA target sequence
gatgtcgttttgtcttcttctttattt

SEQ ID NO: 251965 - DNA, 27 bp, Artificial sequence
  SiRNA target sequence
atgtcgttttgtcttcttctttattta

SEQ ID NO: 251966 - DNA, 27 bp, Artificial sequence
  SiRNA target sequence
tgtcgttttgtcttcttctttatttat

SEQ ID NO: 251967 - DNA, 27 bp, Artificial sequence
  SiRNA target sequence
gtcgttttgtcttcttctttatttata

SEQ ID NO: 251968 - DNA, 27 bp, Artificial sequence
  SiRNA target sequence
tcgttttgtcttcttctttatttatag

SEQ ID NO: 251969 - DNA, 27 bp, Artificial sequence
  SiRNA target sequence
cgttttgtcttcttctttatttatagt

SEQ ID NO: 251970 - DNA, 27 bp, Artificial sequence
  SiRNA target sequence
gttttgtcttcttctttatttatagtt

SEQ ID NO: 251971 - DNA, 27 bp, Artificial sequence
  SiRNA target sequence
ttttgtcttcttctttatttatagttt

SEQ ID NO: 251972 - DNA, 27 bp, Artificial sequence
  SiRNA target sequence
tttgtcttcttctttatttatagtttc

SEQ ID NO: 251973 - DNA, 27 bp, Artificial sequence
  SiRNA target sequence
ttgtcttcttctttatttatagtttcc

SEQ ID NO: 251974 - DNA, 27 bp, Artificial sequence
  SiRNA target sequence
tgtcttcttctttatttatagtttcct

SEQ ID NO: 251975 - DNA, 27 bp, Artificial sequence
  SiRNA target sequence
gtcttcttctttatttatagtttcctt

SEQ ID NO: 251976 - DNA, 27 bp, Artificial sequence
  SiRNA target sequence
tcttcttctttatttatagtttccttt

SEQ ID NO: 251977 - DNA, 27 bp, Artificial sequence
  SiRNA target sequence
cttcttctttatttatagtttccttta

SEQ ID NO: 251978 - DNA, 27 bp, Artificial sequence
  SiRNA target sequence
ttcttctttatttatagtttcctttat

SEQ ID NO: 251979 - DNA, 27 bp, Artificial sequence
  SiRNA target sequence
tcttctttatttatagtttcctttatt

SEQ ID NO: 251980 - DNA, 27 bp, Artificial sequence
  SiRNA target sequence
cttctttatttatagtttcctttattt

SEQ ID NO: 251981 - DNA, 27 bp, Artificial sequence
  SiRNA target sequence
ttctttatttatagtttcctttatttc

SEQ ID NO: 251982 - DNA, 27 bp, Artificial sequence
  SiRNA target sequence
tctttatttatagtttcctttatttct

SEQ ID NO: 251983 - DNA, 27 bp, Artificial sequence
  SiRNA target sequence
ctttatttatagtttcctttatttctt

SEQ ID NO: 251984 - DNA, 27 bp, Artificial sequence
  SiRNA target sequence
tttatttatagtttcctttatttcttt

SEQ ID NO: 251985 - DNA, 27 bp, Artificial sequence
  SiRNA target sequence
ttatttatagtttcctttatttcttta

SEQ ID NO: 251986 - DNA, 27 bp, Artificial sequence
  SiRNA target sequence
tatttatagtttcctttatttctttag

SEQ ID NO: 251987 - DNA, 27 bp, Artificial sequence
  SiRNA target sequence
atttatagtttcctttatttctttagt

SEQ ID NO: 251988 - DNA, 27 bp, Artificial sequence
  SiRNA target sequence
tttatagtttcctttatttctttagtt

SEQ ID NO: 251989 - DNA, 27 bp, Artificial sequence
  SiRNA target sequence
ttatagtttcctttatttctttagttt

SEQ ID NO: 251990 - DNA, 27 bp, Artificial sequence
  SiRNA target sequence
tatagtttcctttatttctttagtttt

SEQ ID NO: 251991 - DNA, 27 bp, Artificial sequence
  SiRNA target sequence
atagtttcctttatttctttagtttta

SEQ ID NO: 251992 - DNA, 27 bp, Artificial sequence
  SiRNA target sequence
tagtttcctttatttctttagttttaa

SEQ ID NO: 251993 - DNA, 27 bp, Artificial sequence
  SiRNA target sequence
agtttcctttatttctttagttttaag

SEQ ID NO: 251994 - DNA, 27 bp, Artificial sequence
  SiRNA target sequence
gtttcctttatttctttagttttaaga

SEQ ID NO: 251995 - DNA, 27 bp, Artificial sequence
  SiRNA target sequence
tttcctttatttctttagttttaagag

SEQ ID NO: 251996 - DNA, 27 bp, Artificial sequence
  SiRNA target sequence
ttcctttatttctttagttttaagagg

SEQ ID NO: 251997 - DNA, 27 bp, Artificial sequence
  SiRNA target sequence
tcctttatttctttagttttaagagga

SEQ ID NO: 251998 - DNA, 27 bp, Artificial sequence
  SiRNA target sequence
cctttatttctttagttttaagaggaa

SEQ ID NO: 251999 - DNA, 27 bp, Artificial sequence
  SiRNA target sequence
ctttatttctttagttttaagaggaat

SEQ ID NO: 252000 - DNA, 27 bp, Artificial sequence
  SiRNA target sequence
tttatttctttagttttaagaggaata

SEQ ID NO: 252001 - DNA, 27 bp, Artificial sequence
  SiRNA target sequence
ttatttctttagttttaagaggaatat

SEQ ID NO: 252002 - DNA, 27 bp, Artificial sequence
  SiRNA target sequence
tatttctttagttttaagaggaatata

SEQ ID NO: 252003 - DNA, 27 bp, Artificial sequence
  SiRNA target sequence
atttctttagttttaagaggaatataa

SEQ ID NO: 252004 - DNA, 27 bp, Artificial sequence
  SiRNA target sequence
tttctttagttttaagaggaatataac

SEQ ID NO: 252005 - DNA, 27 bp, Artificial sequence
  SiRNA target sequence
ttctttagttttaagaggaatataact

SEQ ID NO: 252006 - DNA, 27 bp, Artificial sequence
  SiRNA target sequence
tctttagttttaagaggaatataactt

SEQ ID NO: 252007 - DNA, 27 bp, Artificial sequence
  SiRNA target sequence
ctttagttttaagaggaatataacttt

SEQ ID NO: 252008 - DNA, 27 bp, Artificial sequence
  SiRNA target sequence
tttagttttaagaggaatataactttt

SEQ ID NO: 252009 - DNA, 27 bp, Artificial sequence
  SiRNA target sequence
ttagttttaagaggaatataacttttt

SEQ ID NO: 252010 - DNA, 27 bp, Artificial sequence
  SiRNA target sequence
tagttttaagaggaatataacttttta

SEQ ID NO: 252011 - DNA, 27 bp, Artificial sequence
  SiRNA target sequence
agttttaagaggaatataactttttaa

SEQ ID NO: 252012 - DNA, 27 bp, Artificial sequence
  SiRNA target sequence
gttttaagaggaatataactttttaaa

SEQ ID NO: 252013 - DNA, 27 bp, Artificial sequence
  SiRNA target sequence
ttttaagaggaatataactttttaaaa

SEQ ID NO: 252014 - DNA, 27 bp, Artificial sequence
  SiRNA target sequence
tttaagaggaatataactttttaaaaa

SEQ ID NO: 252015 - DNA, 27 bp, Artificial sequence
  SiRNA target sequence
ttaagaggaatataactttttaaaaag

SEQ ID NO: 252016 - DNA, 27 bp, Artificial sequence
  SiRNA target sequence
taagaggaatataactttttaaaaagt

SEQ ID NO: 252017 - DNA, 27 bp, Artificial sequence
  SiRNA target sequence
aagaggaatataactttttaaaaagta

SEQ ID NO: 252018 - DNA, 27 bp, Artificial sequence
  SiRNA target sequence
agaggaatataactttttaaaaagtaa

SEQ ID NO: 252019 - DNA, 27 bp, Artificial sequence
  SiRNA target sequence
gaggaatataactttttaaaaagtaaa

SEQ ID NO: 252020 - DNA, 27 bp, Artificial sequence
  SiRNA target sequence
aggaatataactttttaaaaagtaaat

SEQ ID NO: 252021 - DNA, 27 bp, Artificial sequence
  SiRNA target sequence
ggaatataactttttaaaaagtaaatt

SEQ ID NO: 252022 - DNA, 27 bp, Artificial sequence
  SiRNA target sequence
gaatataactttttaaaaagtaaatta

SEQ ID NO: 252023 - DNA, 27 bp, Artificial sequence
  SiRNA target sequence
aatataactttttaaaaagtaaattaa

SEQ ID NO: 252024 - DNA, 27 bp, Artificial sequence
  SiRNA target sequence
atataactttttaaaaagtaaattaat

SEQ ID NO: 252025 - DNA, 27 bp, Artificial sequence
  SiRNA target sequence
tataactttttaaaaagtaaattaatg

SEQ ID NO: 252026 - DNA, 27 bp, Artificial sequence
  SiRNA target sequence
ataactttttaaaaagtaaattaatgt

SEQ ID NO: 252027 - DNA, 27 bp, Artificial sequence
  SiRNA target sequence
taactttttaaaaagtaaattaatgta

SEQ ID NO: 252028 - DNA, 27 bp, Artificial sequence
  SiRNA target sequence
aactttttaaaaagtaaattaatgtag

SEQ ID NO: 252029 - DNA, 27 bp, Artificial sequence
  SiRNA target sequence
actttttaaaaagtaaattaatgtagt

SEQ ID NO: 252030 - DNA, 27 bp, Artificial sequence
  SiRNA target sequence
ctttttaaaaagtaaattaatgtagtt

SEQ ID NO: 252031 - DNA, 27 bp, Artificial sequence
  SiRNA target sequence
tttttaaaaagtaaattaatgtagtta

SEQ ID NO: 252032 - DNA, 27 bp, Artificial sequence
  SiRNA target sequence
ttttaaaaagtaaattaatgtagttac

SEQ ID NO: 252033 - DNA, 27 bp, Artificial sequence
  SiRNA target sequence
tttaaaaagtaaattaatgtagttaca

SEQ ID NO: 252034 - DNA, 27 bp, Artificial sequence
  SiRNA target sequence
ttaaaaagtaaattaatgtagttacaa

SEQ ID NO: 252035 - DNA, 27 bp, Artificial sequence
  SiRNA target sequence
taaaaagtaaattaatgtagttacaaa

SEQ ID NO: 252036 - DNA, 27 bp, Artificial sequence
  SiRNA target sequence
aaaaagtaaattaatgtagttacaaaa

SEQ ID NO: 252037 - DNA, 27 bp, Artificial sequence
  SiRNA target sequence
aaaagtaaattaatgtagttacaaaag

SEQ ID NO: 252038 - DNA, 27 bp, Artificial sequence
  SiRNA target sequence
aaagtaaattaatgtagttacaaaaga

SEQ ID NO: 252039 - DNA, 27 bp, Artificial sequence
  SiRNA target sequence
aagtaaattaatgtagttacaaaagac

SEQ ID NO: 252040 - DNA, 27 bp, Artificial sequence
  SiRNA target sequence
agtaaattaatgtagttacaaaagaca

SEQ ID NO: 252041 - DNA, 27 bp, Artificial sequence
  SiRNA target sequence
gtaaattaatgtagttacaaaagacaa

SEQ ID NO: 252042 - DNA, 27 bp, Artificial sequence
  SiRNA target sequence
taaattaatgtagttacaaaagacaag

SEQ ID NO: 252043 - DNA, 27 bp, Artificial sequence
  SiRNA target sequence
aaattaatgtagttacaaaagacaaga

SEQ ID NO: 252044 - DNA, 27 bp, Artificial sequence
  SiRNA target sequence
aattaatgtagttacaaaagacaagat

SEQ ID NO: 252045 - DNA, 27 bp, Artificial sequence
  SiRNA target sequence
attaatgtagttacaaaagacaagatc

SEQ ID NO: 252046 - DNA, 27 bp, Artificial sequence
  SiRNA target sequence
ttaatgtagttacaaaagacaagatca

SEQ ID NO: 252047 - DNA, 27 bp, Artificial sequence
  SiRNA target sequence
taatgtagttacaaaagacaagatcaa

SEQ ID NO: 252048 - DNA, 27 bp, Artificial sequence
  SiRNA target sequence
aatgtagttacaaaagacaagatcaaa

SEQ ID NO: 252049 - DNA, 27 bp, Artificial sequence
  SiRNA target sequence
atgtagttacaaaagacaagatcaaaa

SEQ ID NO: 252050 - DNA, 27 bp, Artificial sequence
  SiRNA target sequence
tgtagttacaaaagacaagatcaaaaa

SEQ ID NO: 252051 - DNA, 27 bp, Artificial sequence
  SiRNA target sequence
gtagttacaaaagacaagatcaaaaaa

SEQ ID NO: 252052 - DNA, 27 bp, Artificial sequence
  SiRNA target sequence
tagttacaaaagacaagatcaaaaaaa

SEQ ID NO: 252053 - DNA, 27 bp, Artificial sequence
  SiRNA target sequence
agttacaaaagacaagatcaaaaaaaa

SEQ ID NO: 252054 - DNA, 27 bp, Artificial sequence
  SiRNA target sequence
gttacaaaagacaagatcaaaaaaaac

SEQ ID NO: 252055 - DNA, 27 bp, Artificial sequence
  SiRNA target sequence
ttacaaaagacaagatcaaaaaaaaca

SEQ ID NO: 252056 - DNA, 27 bp, Artificial sequence
  SiRNA target sequence
tacaaaagacaagatcaaaaaaaacaa

SEQ ID NO: 252057 - DNA, 27 bp, Artificial sequence
  SiRNA target sequence
acaaaagacaagatcaaaaaaaacaaa

SEQ ID NO: 252058 - DNA, 27 bp, Artificial sequence
  SiRNA target sequence
caaaagacaagatcaaaaaaaacaaac

SEQ ID NO: 252059 - DNA, 27 bp, Artificial sequence
  SiRNA target sequence
aaaagacaagatcaaaaaaaacaaact

SEQ ID NO: 252060 - DNA, 27 bp, Artificial sequence
  SiRNA target sequence
aaagacaagatcaaaaaaaacaaacta

SEQ ID NO: 252061 - DNA, 27 bp, Artificial sequence
  SiRNA target sequence
aagacaagatcaaaaaaaacaaactac

SEQ ID NO: 252062 - DNA, 27 bp, Artificial sequence
  SiRNA target sequence
agacaagatcaaaaaaaacaaactact

SEQ ID NO: 252063 - DNA, 27 bp, Artificial sequence
  SiRNA target sequence
gacaagatcaaaaaaaacaaactacta

SEQ ID NO: 252064 - DNA, 27 bp, Artificial sequence
  SiRNA target sequence
acaagatcaaaaaaaacaaactactac

SEQ ID NO: 252065 - DNA, 27 bp, Artificial sequence
  SiRNA target sequence
caagatcaaaaaaaacaaactactacc

SEQ ID NO: 252066 - DNA, 27 bp, Artificial sequence
  SiRNA target sequence
aagatcaaaaaaaacaaactactaccg

SEQ ID NO: 252067 - DNA, 27 bp, Artificial sequence
  SiRNA target sequence
agatcaaaaaaaacaaactactaccgt

SEQ ID NO: 252068 - DNA, 27 bp, Artificial sequence
  SiRNA target sequence
gatcaaaaaaaacaaactactaccgtc

SEQ ID NO: 252069 - DNA, 27 bp, Artificial sequence
  SiRNA target sequence
atcaaaaaaaacaaactactaccgtca

SEQ ID NO: 252070 - DNA, 27 bp, Artificial sequence
  SiRNA target sequence
tcaaaaaaaacaaactactaccgtcaa

SEQ ID NO: 252071 - DNA, 27 bp, Artificial sequence
  SiRNA target sequence
caaaaaaaacaaactactaccgtcaat

SEQ ID NO: 252072 - DNA, 27 bp, Artificial sequence
  SiRNA target sequence
aaaaaaaacaaactactaccgtcaatt

SEQ ID NO: 252073 - DNA, 27 bp, Artificial sequence
  SiRNA target sequence
aaaaaaacaaactactaccgtcaattt

SEQ ID NO: 252074 - DNA, 27 bp, Artificial sequence
  SiRNA target sequence
aaaaaacaaactactaccgtcaatttt

SEQ ID NO: 252075 - DNA, 27 bp, Artificial sequence
  SiRNA target sequence
aaaaacaaactactaccgtcaatttta

SEQ ID NO: 252076 - DNA, 27 bp, Artificial sequence
  SiRNA target sequence
aaaacaaactactaccgtcaattttat

SEQ ID NO: 252077 - DNA, 27 bp, Artificial sequence
  SiRNA target sequence
aaacaaactactaccgtcaattttatc

SEQ ID NO: 252078 - DNA, 27 bp, Artificial sequence
  SiRNA target sequence
aacaaactactaccgtcaattttatca

SEQ ID NO: 252079 - DNA, 27 bp, Artificial sequence
  SiRNA target sequence
acaaactactaccgtcaattttatcat

SEQ ID NO: 252080 - DNA, 27 bp, Artificial sequence
  SiRNA target sequence
caaactactaccgtcaattttatcatg

SEQ ID NO: 252081 - DNA, 27 bp, Artificial sequence
  SiRNA target sequence
aaactactaccgtcaattttatcatgc

SEQ ID NO: 252082 - DNA, 27 bp, Artificial sequence
  SiRNA target sequence
aactactaccgtcaattttatcatgca

SEQ ID NO: 252083 - DNA, 27 bp, Artificial sequence
  SiRNA target sequence
actactaccgtcaattttatcatgcaa

SEQ ID NO: 252084 - DNA, 27 bp, Artificial sequence
  SiRNA target sequence
ctactaccgtcaattttatcatgcaaa

SEQ ID NO: 252085 - DNA, 27 bp, Artificial sequence
  SiRNA target sequence
tactaccgtcaattttatcatgcaaac

SEQ ID NO: 252086 - DNA, 27 bp, Artificial sequence
  SiRNA target sequence
actaccgtcaattttatcatgcaaacc

SEQ ID NO: 252087 - DNA, 27 bp, Artificial sequence
  SiRNA target sequence
ctaccgtcaattttatcatgcaaacct

SEQ ID NO: 252088 - DNA, 27 bp, Artificial sequence
  SiRNA target sequence
taccgtcaattttatcatgcaaacctg

SEQ ID NO: 252089 - DNA, 27 bp, Artificial sequence
  SiRNA target sequence
accgtcaattttatcatgcaaacctgc

SEQ ID NO: 252090 - DNA, 27 bp, Artificial sequence
  SiRNA target sequence
ccgtcaattttatcatgcaaacctgca

SEQ ID NO: 252091 - DNA, 27 bp, Artificial sequence
  SiRNA target sequence
cgtcaattttatcatgcaaacctgcag

SEQ ID NO: 252092 - DNA, 27 bp, Artificial sequence
  SiRNA target sequence
gtcaattttatcatgcaaacctgcagg

SEQ ID NO: 252093 - DNA, 27 bp, Artificial sequence
  SiRNA target sequence
tcaattttatcatgcaaacctgcagga

SEQ ID NO: 252094 - DNA, 27 bp, Artificial sequence
  SiRNA target sequence
caattttatcatgcaaacctgcaggaa

SEQ ID NO: 252095 - DNA, 27 bp, Artificial sequence
  SiRNA target sequence
aattttatcatgcaaacctgcaggaag

SEQ ID NO: 252096 - DNA, 27 bp, Artificial sequence
  SiRNA target sequence
attttatcatgcaaacctgcaggaagt

SEQ ID NO: 252097 - DNA, 27 bp, Artificial sequence
  SiRNA target sequence
ttttatcatgcaaacctgcaggaagta

SEQ ID NO: 252098 - DNA, 27 bp, Artificial sequence
  SiRNA target sequence
tttatcatgcaaacctgcaggaagtat

SEQ ID NO: 252099 - DNA, 27 bp, Artificial sequence
  SiRNA target sequence
ttatcatgcaaacctgcaggaagtata

SEQ ID NO: 252100 - DNA, 27 bp, Artificial sequence
  SiRNA target sequence
tatcatgcaaacctgcaggaagtatat

SEQ ID NO: 252101 - DNA, 27 bp, Artificial sequence
  SiRNA target sequence
atcatgcaaacctgcaggaagtatatt

SEQ ID NO: 252102 - DNA, 27 bp, Artificial sequence
  SiRNA target sequence
tcatgcaaacctgcaggaagtatattt

SEQ ID NO: 252103 - DNA, 27 bp, Artificial sequence
  SiRNA target sequence
catgcaaacctgcaggaagtatatttg

SEQ ID NO: 252104 - DNA, 27 bp, Artificial sequence
  SiRNA target sequence
atgcaaacctgcaggaagtatatttgc

SEQ ID NO: 252105 - DNA, 27 bp, Artificial sequence
  SiRNA target sequence
tgcaaacctgcaggaagtatatttgct

SEQ ID NO: 252106 - DNA, 27 bp, Artificial sequence
  SiRNA target sequence
gcaaacctgcaggaagtatatttgcta

SEQ ID NO: 252107 - DNA, 27 bp, Artificial sequence
  SiRNA target sequence
caaacctgcaggaagtatatttgctaa

SEQ ID NO: 252108 - DNA, 27 bp, Artificial sequence
  SiRNA target sequence
aaacctgcaggaagtatatttgctaat

SEQ ID NO: 252109 - DNA, 27 bp, Artificial sequence
  SiRNA target sequence
aacctgcaggaagtatatttgctaatt

SEQ ID NO: 252110 - DNA, 27 bp, Artificial sequence
  SiRNA target sequence
acctgcaggaagtatatttgctaattc

SEQ ID NO: 252111 - DNA, 27 bp, Artificial sequence
  SiRNA target sequence
cctgcaggaagtatatttgctaattca

SEQ ID NO: 252112 - DNA, 27 bp, Artificial sequence
  SiRNA target sequence
ctgcaggaagtatatttgctaattcat

SEQ ID NO: 252113 - DNA, 27 bp, Artificial sequence
  SiRNA target sequence
tgcaggaagtatatttgctaattcatc

SEQ ID NO: 252114 - DNA, 27 bp, Artificial sequence
  SiRNA target sequence
gcaggaagtatatttgctaattcatct

SEQ ID NO: 252115 - DNA, 27 bp, Artificial sequence
  SiRNA target sequence
caggaagtatatttgctaattcatctt

SEQ ID NO: 252116 - DNA, 27 bp, Artificial sequence
  SiRNA target sequence
aggaagtatatttgctaattcatcttt

SEQ ID NO: 252117 - DNA, 27 bp, Artificial sequence
  SiRNA target sequence
ggaagtatatttgctaattcatctttt

SEQ ID NO: 252118 - DNA, 27 bp, Artificial sequence
  SiRNA target sequence
gaagtatatttgctaattcatctttta

SEQ ID NO: 252119 - DNA, 27 bp, Artificial sequence
  SiRNA target sequence
aagtatatttgctaattcatcttttat

SEQ ID NO: 252120 - DNA, 27 bp, Artificial sequence
  SiRNA target sequence
agtatatttgctaattcatcttttata

SEQ ID NO: 252121 - DNA, 27 bp, Artificial sequence
  SiRNA target sequence
gtatatttgctaattcatcttttatat

SEQ ID NO: 252122 - DNA, 27 bp, Artificial sequence
  SiRNA target sequence
tatatttgctaattcatcttttatata

SEQ ID NO: 252123 - DNA, 27 bp, Artificial sequence
  SiRNA target sequence
atatttgctaattcatcttttatataa

SEQ ID NO: 252124 - DNA, 27 bp, Artificial sequence
  SiRNA target sequence
tatttgctaattcatcttttatataaa

SEQ ID NO: 252125 - DNA, 27 bp, Artificial sequence
  SiRNA target sequence
atttgctaattcatcttttatataaat

SEQ ID NO: 252126 - DNA, 27 bp, Artificial sequence
  SiRNA target sequence
tttgctaattcatcttttatataaata

SEQ ID NO: 252127 - DNA, 27 bp, Artificial sequence
  SiRNA target sequence
ttgctaattcatcttttatataaataa

SEQ ID NO: 252128 - DNA, 27 bp, Artificial sequence
  SiRNA target sequence
tgctaattcatcttttatataaataaa

SEQ ID NO: 252129 - DNA, 27 bp, Artificial sequence
  SiRNA target sequence
gctaattcatcttttatataaataaaa

SEQ ID NO: 252130 - DNA, 27 bp, Artificial sequence
  SiRNA target sequence
ctaattcatcttttatataaataaaag

SEQ ID NO: 252131 - DNA, 27 bp, Artificial sequence
  SiRNA target sequence
taattcatcttttatataaataaaagc

SEQ ID NO: 252132 - DNA, 27 bp, Artificial sequence
  SiRNA target sequence
aattcatcttttatataaataaaagct

SEQ ID NO: 252133 - DNA, 27 bp, Artificial sequence
  SiRNA target sequence
attcatcttttatataaataaaagcta

SEQ ID NO: 252134 - DNA, 27 bp, Artificial sequence
  SiRNA target sequence
ttcatcttttatataaataaaagctac

SEQ ID NO: 252135 - DNA, 27 bp, Artificial sequence
  SiRNA target sequence
tcatcttttatataaataaaagctaca

SEQ ID NO: 252136 - DNA, 27 bp, Artificial sequence
  SiRNA target sequence
catcttttatataaataaaagctacag

SEQ ID NO: 252137 - DNA, 27 bp, Artificial sequence
  SiRNA target sequence
atcttttatataaataaaagctacaga

SEQ ID NO: 252138 - DNA, 27 bp, Artificial sequence
  SiRNA target sequence
tcttttatataaataaaagctacagaa

SEQ ID NO: 252139 - DNA, 27 bp, Artificial sequence
  SiRNA target sequence
cttttatataaataaaagctacagaaa

SEQ ID NO: 252140 - DNA, 27 bp, Artificial sequence
  SiRNA target sequence
ttttatataaataaaagctacagaaat

SEQ ID NO: 252141 - DNA, 27 bp, Artificial sequence
  SiRNA target sequence
tttatataaataaaagctacagaaata

SEQ ID NO: 252142 - DNA, 27 bp, Artificial sequence
  SiRNA target sequence
ttatataaataaaagctacagaaataa

SEQ ID NO: 252143 - DNA, 27 bp, Artificial sequence
  SiRNA target sequence
tatataaataaaagctacagaaataat

SEQ ID NO: 252144 - DNA, 27 bp, Artificial sequence
  SiRNA target sequence
atataaataaaagctacagaaataatc

SEQ ID NO: 252145 - DNA, 27 bp, Artificial sequence
  SiRNA target sequence
tataaataaaagctacagaaataatca

SEQ ID NO: 252146 - DNA, 27 bp, Artificial sequence
  SiRNA target sequence
ataaataaaagctacagaaataatcat

SEQ ID NO: 252147 - DNA, 27 bp, Artificial sequence
  SiRNA target sequence
taaataaaagctacagaaataatcatt

SEQ ID NO: 252148 - DNA, 27 bp, Artificial sequence
  SiRNA target sequence
aaataaaagctacagaaataatcattg

SEQ ID NO: 252149 - DNA, 27 bp, Artificial sequence
  SiRNA target sequence
aataaaagctacagaaataatcattga

SEQ ID NO: 252150 - DNA, 27 bp, Artificial sequence
  SiRNA target sequence
ataaaagctacagaaataatcattgaa

SEQ ID NO: 252151 - DNA, 27 bp, Artificial sequence
  SiRNA target sequence
taaaagctacagaaataatcattgaaa

SEQ ID NO: 252152 - DNA, 27 bp, Artificial sequence
  SiRNA target sequence
aaaagctacagaaataatcattgaaat

SEQ ID NO: 252153 - DNA, 27 bp, Artificial sequence
  SiRNA target sequence
aaagctacagaaataatcattgaaatg

SEQ ID NO: 252154 - DNA, 27 bp, Artificial sequence
  SiRNA target sequence
aagctacagaaataatcattgaaatgg

SEQ ID NO: 252155 - DNA, 27 bp, Artificial sequence
  SiRNA target sequence
agctacagaaataatcattgaaatggc

SEQ ID NO: 252156 - DNA, 27 bp, Artificial sequence
  SiRNA target sequence
gctacagaaataatcattgaaatggcg

SEQ ID NO: 252157 - DNA, 27 bp, Artificial sequence
  SiRNA target sequence
ctacagaaataatcattgaaatggcgg

SEQ ID NO: 252158 - DNA, 27 bp, Artificial sequence
  SiRNA target sequence
tacagaaataatcattgaaatggcggt

SEQ ID NO: 252159 - DNA, 27 bp, Artificial sequence
  SiRNA target sequence
acagaaataatcattgaaatggcggtg

SEQ ID NO: 252160 - DNA, 27 bp, Artificial sequence
  SiRNA target sequence
cagaaataatcattgaaatggcggtga

SEQ ID NO: 252161 - DNA, 27 bp, Artificial sequence
  SiRNA target sequence
agaaataatcattgaaatggcggtgat

SEQ ID NO: 252162 - DNA, 27 bp, Artificial sequence
  SiRNA target sequence
gaaataatcattgaaatggcggtgatt

SEQ ID NO: 252163 - DNA, 27 bp, Artificial sequence
  SiRNA target sequence
aaataatcattgaaatggcggtgattg

SEQ ID NO: 252164 - DNA, 27 bp, Artificial sequence
  SiRNA target sequence
aataatcattgaaatggcggtgattgt

SEQ ID NO: 252165 - DNA, 27 bp, Artificial sequence
  SiRNA target sequence
ataatcattgaaatggcggtgattgtg

SEQ ID NO: 252166 - DNA, 27 bp, Artificial sequence
  SiRNA target sequence
taatcattgaaatggcggtgattgtgg

SEQ ID NO: 252167 - DNA, 27 bp, Artificial sequence
  SiRNA target sequence
aatcattgaaatggcggtgattgtgga

SEQ ID NO: 252168 - DNA, 27 bp, Artificial sequence
  SiRNA target sequence
atcattgaaatggcggtgattgtggaa

SEQ ID NO: 252169 - DNA, 27 bp, Artificial sequence
  SiRNA target sequence
tcattgaaatggcggtgattgtggaaa

SEQ ID NO: 252170 - DNA, 27 bp, Artificial sequence
  SiRNA target sequence
cattgaaatggcggtgattgtggaaaa

SEQ ID NO: 252171 - DNA, 27 bp, Artificial sequence
  SiRNA target sequence
attgaaatggcggtgattgtggaaaaa

SEQ ID NO: 252172 - DNA, 27 bp, Artificial sequence
  SiRNA target sequence
ttgaaatggcggtgattgtggaaaaat

SEQ ID NO: 252173 - DNA, 27 bp, Artificial sequence
  SiRNA target sequence
tgaaatggcggtgattgtggaaaaatt

SEQ ID NO: 252174 - DNA, 27 bp, Artificial sequence
  SiRNA target sequence
gaaatggcggtgattgtggaaaaatta

SEQ ID NO: 252175 - DNA, 27 bp, Artificial sequence
  SiRNA target sequence
aaatggcggtgattgtggaaaaattag

SEQ ID NO: 252176 - DNA, 27 bp, Artificial sequence
  SiRNA target sequence
aatggcggtgattgtggaaaaattagg

SEQ ID NO: 252177 - DNA, 27 bp, Artificial sequence
  SiRNA target sequence
atggcggtgattgtggaaaaattagga

SEQ ID NO: 252178 - DNA, 27 bp, Artificial sequence
  SiRNA target sequence
tggcggtgattgtggaaaaattaggaa

SEQ ID NO: 252179 - DNA, 27 bp, Artificial sequence
  SiRNA target sequence
ggcggtgattgtggaaaaattaggaac

SEQ ID NO: 252180 - DNA, 27 bp, Artificial sequence
  SiRNA target sequence
gcggtgattgtggaaaaattaggaaca

SEQ ID NO: 252181 - DNA, 27 bp, Artificial sequence
  SiRNA target sequence
cggtgattgtggaaaaattaggaacaa

SEQ ID NO: 252182 - DNA, 27 bp, Artificial sequence
  SiRNA target sequence
ggtgattgtggaaaaattaggaacaat

SEQ ID NO: 252183 - DNA, 27 bp, Artificial sequence
  SiRNA target sequence
gtgattgtggaaaaattaggaacaatt

SEQ ID NO: 252184 - DNA, 27 bp, Artificial sequence
  SiRNA target sequence
tgattgtggaaaaattaggaacaattt

SEQ ID NO: 252185 - DNA, 27 bp, Artificial sequence
  SiRNA target sequence
gattgtggaaaaattaggaacaatttc

SEQ ID NO: 252186 - DNA, 27 bp, Artificial sequence
  SiRNA target sequence
attgtggaaaaattaggaacaatttct

SEQ ID NO: 252187 - DNA, 27 bp, Artificial sequence
  SiRNA target sequence
ttgtggaaaaattaggaacaatttctt

SEQ ID NO: 252188 - DNA, 27 bp, Artificial sequence
  SiRNA target sequence
tgtggaaaaattaggaacaatttcttt

SEQ ID NO: 252189 - DNA, 27 bp, Artificial sequence
  SiRNA target sequence
gtggaaaaattaggaacaatttctttc

SEQ ID NO: 252190 - DNA, 27 bp, Artificial sequence
  SiRNA target sequence
tggaaaaattaggaacaatttctttca

SEQ ID NO: 252191 - DNA, 27 bp, Artificial sequence
  SiRNA target sequence
ggaaaaattaggaacaatttctttcat

SEQ ID NO: 252192 - DNA, 27 bp, Artificial sequence
  SiRNA target sequence
gaaaaattaggaacaatttctttcatt

SEQ ID NO: 252193 - DNA, 27 bp, Artificial sequence
  SiRNA target sequence
aaaaattaggaacaatttctttcattt

SEQ ID NO: 252194 - DNA, 27 bp, Artificial sequence
  SiRNA target sequence
aaaattaggaacaatttctttcatttc

SEQ ID NO: 252195 - DNA, 27 bp, Artificial sequence
  SiRNA target sequence
aaattaggaacaatttctttcatttca

SEQ ID NO: 252196 - DNA, 27 bp, Artificial sequence
  SiRNA target sequence
aattaggaacaatttctttcatttcat

SEQ ID NO: 252197 - DNA, 27 bp, Artificial sequence
  SiRNA target sequence
attaggaacaatttctttcatttcatc

SEQ ID NO: 252198 - DNA, 27 bp, Artificial sequence
  SiRNA target sequence
ttaggaacaatttctttcatttcatct

SEQ ID NO: 252199 - DNA, 27 bp, Artificial sequence
  SiRNA target sequence
taggaacaatttctttcatttcatctt

SEQ ID NO: 252200 - DNA, 27 bp, Artificial sequence
  SiRNA target sequence
aggaacaatttctttcatttcatcttc

SEQ ID NO: 252201 - DNA, 27 bp, Artificial sequence
  SiRNA target sequence
ggaacaatttctttcatttcatcttct

SEQ ID NO: 252202 - DNA, 27 bp, Artificial sequence
  SiRNA target sequence
gaacaatttctttcatttcatcttctg

SEQ ID NO: 252203 - DNA, 27 bp, Artificial sequence
  SiRNA target sequence
aacaatttctttcatttcatcttctgt

SEQ ID NO: 252204 - DNA, 27 bp, Artificial sequence
  SiRNA target sequence
acaatttctttcatttcatcttctgta

SEQ ID NO: 252205 - DNA, 27 bp, Artificial sequence
  SiRNA target sequence
caatttctttcatttcatcttctgtac

SEQ ID NO: 252206 - DNA, 27 bp, Artificial sequence
  SiRNA target sequence
aatttctttcatttcatcttctgtaca

SEQ ID NO: 252207 - DNA, 27 bp, Artificial sequence
  SiRNA target sequence
atttctttcatttcatcttctgtacaa

SEQ ID NO: 252208 - DNA, 27 bp, Artificial sequence
  SiRNA target sequence
tttctttcatttcatcttctgtacaag

SEQ ID NO: 252209 - DNA, 27 bp, Artificial sequence
  SiRNA target sequence
ttctttcatttcatcttctgtacaagc

SEQ ID NO: 252210 - DNA, 27 bp, Artificial sequence
  SiRNA target sequence
tctttcatttcatcttctgtacaagca

SEQ ID NO: 252211 - DNA, 27 bp, Artificial sequence
  SiRNA target sequence
ctttcatttcatcttctgtacaagcat

SEQ ID NO: 252212 - DNA, 27 bp, Artificial sequence
  SiRNA target sequence
tttcatttcatcttctgtacaagcatg

SEQ ID NO: 252213 - DNA, 27 bp, Artificial sequence
  SiRNA target sequence
ttcatttcatcttctgtacaagcatga

SEQ ID NO: 252214 - DNA, 27 bp, Artificial sequence
  SiRNA target sequence
tcatttcatcttctgtacaagcatgat

SEQ ID NO: 252215 - DNA, 27 bp, Artificial sequence
  SiRNA target sequence
catttcatcttctgtacaagcatgatt

SEQ ID NO: 252216 - DNA, 27 bp, Artificial sequence
  SiRNA target sequence
atttcatcttctgtacaagcatgattg

SEQ ID NO: 252217 - DNA, 27 bp, Artificial sequence
  SiRNA target sequence
tttcatcttctgtacaagcatgattgg

SEQ ID NO: 252218 - DNA, 27 bp, Artificial sequence
  SiRNA target sequence
ttcatcttctgtacaagcatgattggc

SEQ ID NO: 252219 - DNA, 27 bp, Artificial sequence
  SiRNA target sequence
tcatcttctgtacaagcatgattggct

SEQ ID NO: 252220 - DNA, 27 bp, Artificial sequence
  SiRNA target sequence
catcttctgtacaagcatgattggcta

SEQ ID NO: 252221 - DNA, 27 bp, Artificial sequence
  SiRNA target sequence
atcttctgtacaagcatgattggctaa

SEQ ID NO: 252222 - DNA, 27 bp, Artificial sequence
  SiRNA target sequence
tcttctgtacaagcatgattggctaac

SEQ ID NO: 252223 - DNA, 27 bp, Artificial sequence
  SiRNA target sequence
cttctgtacaagcatgattggctaacg

SEQ ID NO: 252224 - DNA, 27 bp, Artificial sequence
  SiRNA target sequence
ttctgtacaagcatgattggctaacgc

SEQ ID NO: 252225 - DNA, 27 bp, Artificial sequence
  SiRNA target sequence
tctgtacaagcatgattggctaacgca

SEQ ID NO: 252226 - DNA, 27 bp, Artificial sequence
  SiRNA target sequence
ctgtacaagcatgattggctaacgcat

SEQ ID NO: 252227 - DNA, 27 bp, Artificial sequence
  SiRNA target sequence
tgtacaagcatgattggctaacgcata

SEQ ID NO: 252228 - DNA, 27 bp, Artificial sequence
  SiRNA target sequence
gtacaagcatgattggctaacgcatat

SEQ ID NO: 252229 - DNA, 27 bp, Artificial sequence
  SiRNA target sequence
tacaagcatgattggctaacgcatata

SEQ ID NO: 252230 - DNA, 27 bp, Artificial sequence
  SiRNA target sequence
acaagcatgattggctaacgcatataa

SEQ ID NO: 252231 - DNA, 27 bp, Artificial sequence
  SiRNA target sequence
caagcatgattggctaacgcatataaa

SEQ ID NO: 252232 - DNA, 27 bp, Artificial sequence
  SiRNA target sequence
aagcatgattggctaacgcatataaag

SEQ ID NO: 252233 - DNA, 27 bp, Artificial sequence
  SiRNA target sequence
agcatgattggctaacgcatataaagc

SEQ ID NO: 252234 - DNA, 27 bp, Artificial sequence
  SiRNA target sequence
gcatgattggctaacgcatataaagca

SEQ ID NO: 252235 - DNA, 27 bp, Artificial sequence
  SiRNA target sequence
catgattggctaacgcatataaagcaa

SEQ ID NO: 252236 - DNA, 27 bp, Artificial sequence
  SiRNA target sequence
atgattggctaacgcatataaagcaaa

SEQ ID NO: 252237 - DNA, 27 bp, Artificial sequence
  SiRNA target sequence
tgattggctaacgcatataaagcaaaa

SEQ ID NO: 252238 - DNA, 27 bp, Artificial sequence
  SiRNA target sequence
gattggctaacgcatataaagcaaaac

SEQ ID NO: 252239 - DNA, 27 bp, Artificial sequence
  SiRNA target sequence
attggctaacgcatataaagcaaaacc

SEQ ID NO: 252240 - DNA, 27 bp, Artificial sequence
  SiRNA target sequence
ttggctaacgcatataaagcaaaacca

SEQ ID NO: 252241 - DNA, 27 bp, Artificial sequence
  SiRNA target sequence
tggctaacgcatataaagcaaaaccaa

SEQ ID NO: 252242 - DNA, 27 bp, Artificial sequence
  SiRNA target sequence
ggctaacgcatataaagcaaaaccaac

SEQ ID NO: 252243 - DNA, 27 bp, Artificial sequence
  SiRNA target sequence
gctaacgcatataaagcaaaaccaact

SEQ ID NO: 252244 - DNA, 27 bp, Artificial sequence
  SiRNA target sequence
ctaacgcatataaagcaaaaccaacta

SEQ ID NO: 252245 - DNA, 27 bp, Artificial sequence
  SiRNA target sequence
taacgcatataaagcaaaaccaactac

SEQ ID NO: 252246 - DNA, 27 bp, Artificial sequence
  SiRNA target sequence
aacgcatataaagcaaaaccaactact

SEQ ID NO: 252247 - DNA, 27 bp, Artificial sequence
  SiRNA target sequence
acgcatataaagcaaaaccaactacta

SEQ ID NO: 252248 - DNA, 27 bp, Artificial sequence
  SiRNA target sequence
cgcatataaagcaaaaccaactactag

SEQ ID NO: 252249 - DNA, 27 bp, Artificial sequence
  SiRNA target sequence
gcatataaagcaaaaccaactactaga

SEQ ID NO: 252250 - DNA, 27 bp, Artificial sequence
  SiRNA target sequence
catataaagcaaaaccaactactagag

SEQ ID NO: 252251 - DNA, 27 bp, Artificial sequence
  SiRNA target sequence
atataaagcaaaaccaactactagagt

SEQ ID NO: 252252 - DNA, 27 bp, Artificial sequence
  SiRNA target sequence
tataaagcaaaaccaactactagagta

SEQ ID NO: 252253 - DNA, 27 bp, Artificial sequence
  SiRNA target sequence
ataaagcaaaaccaactactagagtac

SEQ ID NO: 252254 - DNA, 27 bp, Artificial sequence
  SiRNA target sequence
taaagcaaaaccaactactagagtact

SEQ ID NO: 252255 - DNA, 27 bp, Artificial sequence
  SiRNA target sequence
aaagcaaaaccaactactagagtactc

SEQ ID NO: 252256 - DNA, 27 bp, Artificial sequence
  SiRNA target sequence
aagcaaaaccaactactagagtactcc

SEQ ID NO: 252257 - DNA, 27 bp, Artificial sequence
  SiRNA target sequence
agcaaaaccaactactagagtactcca

SEQ ID NO: 252258 - DNA, 27 bp, Artificial sequence
  SiRNA target sequence
gcaaaaccaactactagagtactccac

SEQ ID NO: 252259 - DNA, 27 bp, Artificial sequence
  SiRNA target sequence
caaaaccaactactagagtactccaca

SEQ ID NO: 252260 - DNA, 27 bp, Artificial sequence
  SiRNA target sequence
aaaaccaactactagagtactccacaa

SEQ ID NO: 252261 - DNA, 27 bp, Artificial sequence
  SiRNA target sequence
aaaccaactactagagtactccacaac

SEQ ID NO: 252262 - DNA, 27 bp, Artificial sequence
  SiRNA target sequence
aaccaactactagagtactccacaact

SEQ ID NO: 252263 - DNA, 27 bp, Artificial sequence
  SiRNA target sequence
accaactactagagtactccacaactc

SEQ ID NO: 252264 - DNA, 27 bp, Artificial sequence
  SiRNA target sequence
ccaactactagagtactccacaactcc

SEQ ID NO: 252265 - DNA, 27 bp, Artificial sequence
  SiRNA target sequence
caactactagagtactccacaactccg

SEQ ID NO: 252266 - DNA, 27 bp, Artificial sequence
  SiRNA target sequence
aactactagagtactccacaactccga

SEQ ID NO: 252267 - DNA, 27 bp, Artificial sequence
  SiRNA target sequence
actactagagtactccacaactccgat

SEQ ID NO: 252268 - DNA, 27 bp, Artificial sequence
  SiRNA target sequence
ctactagagtactccacaactccgata

SEQ ID NO: 252269 - DNA, 27 bp, Artificial sequence
  SiRNA target sequence
tactagagtactccacaactccgataa

SEQ ID NO: 252270 - DNA, 27 bp, Artificial sequence
  SiRNA target sequence
actagagtactccacaactccgataag

SEQ ID NO: 252271 - DNA, 27 bp, Artificial sequence
  SiRNA target sequence
ctagagtactccacaactccgataaga

SEQ ID NO: 252272 - DNA, 27 bp, Artificial sequence
  SiRNA target sequence
tagagtactccacaactccgataagat

SEQ ID NO: 252273 - DNA, 27 bp, Artificial sequence
  SiRNA target sequence
agagtactccacaactccgataagatg

SEQ ID NO: 252274 - DNA, 27 bp, Artificial sequence
  SiRNA target sequence
gagtactccacaactccgataagatgt

SEQ ID NO: 252275 - DNA, 27 bp, Artificial sequence
  SiRNA target sequence
agtactccacaactccgataagatgta

SEQ ID NO: 252276 - DNA, 27 bp, Artificial sequence
  SiRNA target sequence
gtactccacaactccgataagatgtaa

SEQ ID NO: 252277 - DNA, 27 bp, Artificial sequence
  SiRNA target sequence
tactccacaactccgataagatgtaac

SEQ ID NO: 252278 - DNA, 27 bp, Artificial sequence
  SiRNA target sequence
actccacaactccgataagatgtaaca

SEQ ID NO: 252279 - DNA, 27 bp, Artificial sequence
  SiRNA target sequence
ctccacaactccgataagatgtaacat

SEQ ID NO: 252280 - DNA, 27 bp, Artificial sequence
  SiRNA target sequence
tccacaactccgataagatgtaacata

SEQ ID NO: 252281 - DNA, 27 bp, Artificial sequence
  SiRNA target sequence
ccacaactccgataagatgtaacataa

SEQ ID NO: 252282 - DNA, 27 bp, Artificial sequence
  SiRNA target sequence
cacaactccgataagatgtaacataaa

SEQ ID NO: 252283 - DNA, 27 bp, Artificial sequence
  SiRNA target sequence
acaactccgataagatgtaacataaag

SEQ ID NO: 252284 - DNA, 27 bp, Artificial sequence
  SiRNA target sequence
caactccgataagatgtaacataaagt

SEQ ID NO: 252285 - DNA, 27 bp, Artificial sequence
  SiRNA target sequence
aactccgataagatgtaacataaagta

SEQ ID NO: 252286 - DNA, 27 bp, Artificial sequence
  SiRNA target sequence
actccgataagatgtaacataaagtac

SEQ ID NO: 252287 - DNA, 27 bp, Artificial sequence
  SiRNA target sequence
ctccgataagatgtaacataaagtact

SEQ ID NO: 252288 - DNA, 27 bp, Artificial sequence
  SiRNA target sequence
tccgataagatgtaacataaagtactt

SEQ ID NO: 252289 - DNA, 27 bp, Artificial sequence
  SiRNA target sequence
ccgataagatgtaacataaagtactta

SEQ ID NO: 252290 - DNA, 27 bp, Artificial sequence
  SiRNA target sequence
cgataagatgtaacataaagtacttat

SEQ ID NO: 252291 - DNA, 27 bp, Artificial sequence
  SiRNA target sequence
gataagatgtaacataaagtacttatc

SEQ ID NO: 252292 - DNA, 27 bp, Artificial sequence
  SiRNA target sequence
ataagatgtaacataaagtacttatcc

SEQ ID NO: 252293 - DNA, 27 bp, Artificial sequence
  SiRNA target sequence
taagatgtaacataaagtacttatcca

SEQ ID NO: 252294 - DNA, 27 bp, Artificial sequence
  SiRNA target sequence
aagatgtaacataaagtacttatccac

SEQ ID NO: 252295 - DNA, 27 bp, Artificial sequence
  SiRNA target sequence
agatgtaacataaagtacttatccact

SEQ ID NO: 252296 - DNA, 27 bp, Artificial sequence
  SiRNA target sequence
gatgtaacataaagtacttatccactc

SEQ ID NO: 252297 - DNA, 27 bp, Artificial sequence
  SiRNA target sequence
atgtaacataaagtacttatccactca

SEQ ID NO: 252298 - DNA, 27 bp, Artificial sequence
  SiRNA target sequence
tgtaacataaagtacttatccactcac

SEQ ID NO: 252299 - DNA, 27 bp, Artificial sequence
  SiRNA target sequence
gtaacataaagtacttatccactcact

SEQ ID NO: 252300 - DNA, 27 bp, Artificial sequence
  SiRNA target sequence
taacataaagtacttatccactcactg

SEQ ID NO: 252301 - DNA, 27 bp, Artificial sequence
  SiRNA target sequence
aacataaagtacttatccactcactgt

SEQ ID NO: 252302 - DNA, 27 bp, Artificial sequence
  SiRNA target sequence
acataaagtacttatccactcactgta

SEQ ID NO: 252303 - DNA, 27 bp, Artificial sequence
  SiRNA target sequence
cataaagtacttatccactcactgtac

SEQ ID NO: 252304 - DNA, 27 bp, Artificial sequence
  SiRNA target sequence
ataaagtacttatccactcactgtaca

SEQ ID NO: 252305 - DNA, 27 bp, Artificial sequence
  SiRNA target sequence
taaagtacttatccactcactgtacat

SEQ ID NO: 252306 - DNA, 27 bp, Artificial sequence
  SiRNA target sequence
aaagtacttatccactcactgtacata

SEQ ID NO: 252307 - DNA, 27 bp, Artificial sequence
  SiRNA target sequence
aagtacttatccactcactgtacatat

SEQ ID NO: 252308 - DNA, 27 bp, Artificial sequence
  SiRNA target sequence
agtacttatccactcactgtacatata

SEQ ID NO: 252309 - DNA, 27 bp, Artificial sequence
  SiRNA target sequence
gtacttatccactcactgtacatatat

SEQ ID NO: 252310 - DNA, 27 bp, Artificial sequence
  SiRNA target sequence
tacttatccactcactgtacatatata

SEQ ID NO: 252311 - DNA, 27 bp, Artificial sequence
  SiRNA target sequence
acttatccactcactgtacatatataa

SEQ ID NO: 252312 - DNA, 27 bp, Artificial sequence
  SiRNA target sequence
cttatccactcactgtacatatataaa

SEQ ID NO: 252313 - DNA, 27 bp, Artificial sequence
  SiRNA target sequence
ttatccactcactgtacatatataaaa

SEQ ID NO: 252314 - DNA, 27 bp, Artificial sequence
  SiRNA target sequence
tatccactcactgtacatatataaaaa

SEQ ID NO: 252315 - DNA, 27 bp, Artificial sequence
  SiRNA target sequence
atccactcactgtacatatataaaaaa

SEQ ID NO: 252316 - DNA, 27 bp, Artificial sequence
  SiRNA target sequence
tccactcactgtacatatataaaaaag

SEQ ID NO: 252317 - DNA, 27 bp, Artificial sequence
  SiRNA target sequence
ccactcactgtacatatataaaaaagg

SEQ ID NO: 252318 - DNA, 27 bp, Artificial sequence
  SiRNA target sequence
cactcactgtacatatataaaaaagga

SEQ ID NO: 252319 - DNA, 27 bp, Artificial sequence
  SiRNA target sequence
actcactgtacatatataaaaaaggag

SEQ ID NO: 252320 - DNA, 27 bp, Artificial sequence
  SiRNA target sequence
ctcactgtacatatataaaaaaggaga

SEQ ID NO: 252321 - DNA, 27 bp, Artificial sequence
  SiRNA target sequence
tcactgtacatatataaaaaaggagat

SEQ ID NO: 252322 - DNA, 27 bp, Artificial sequence
  SiRNA target sequence
cactgtacatatataaaaaaggagata

SEQ ID NO: 252323 - DNA, 27 bp, Artificial sequence
  SiRNA target sequence
actgtacatatataaaaaaggagataa

SEQ ID NO: 252324 - DNA, 27 bp, Artificial sequence
  SiRNA target sequence
ctgtacatatataaaaaaggagataag

SEQ ID NO: 252325 - DNA, 27 bp, Artificial sequence
  SiRNA target sequence
tgtacatatataaaaaaggagataagc

SEQ ID NO: 252326 - DNA, 27 bp, Artificial sequence
  SiRNA target sequence
gtacatatataaaaaaggagataagcc

SEQ ID NO: 252327 - DNA, 27 bp, Artificial sequence
  SiRNA target sequence
tacatatataaaaaaggagataagccc

SEQ ID NO: 252328 - DNA, 27 bp, Artificial sequence
  SiRNA target sequence
acatatataaaaaaggagataagccca

SEQ ID NO: 252329 - DNA, 27 bp, Artificial sequence
  SiRNA target sequence
catatataaaaaaggagataagcccat

SEQ ID NO: 252330 - DNA, 27 bp, Artificial sequence
  SiRNA target sequence
atatataaaaaaggagataagcccatc

SEQ ID NO: 252331 - DNA, 27 bp, Artificial sequence
  SiRNA target sequence
tatataaaaaaggagataagcccatca

SEQ ID NO: 252332 - DNA, 27 bp, Artificial sequence
  SiRNA target sequence
atataaaaaaggagataagcccatcaa

SEQ ID NO: 252333 - DNA, 27 bp, Artificial sequence
  SiRNA target sequence
tataaaaaaggagataagcccatcaag

SEQ ID NO: 252334 - DNA, 27 bp, Artificial sequence
  SiRNA target sequence
ataaaaaaggagataagcccatcaagc

SEQ ID NO: 252335 - DNA, 27 bp, Artificial sequence
  SiRNA target sequence
taaaaaaggagataagcccatcaagct

SEQ ID NO: 252336 - DNA, 27 bp, Artificial sequence
  SiRNA target sequence
aaaaaaggagataagcccatcaagctt

SEQ ID NO: 252337 - DNA, 27 bp, Artificial sequence
  SiRNA target sequence
aaaaaggagataagcccatcaagcttc

SEQ ID NO: 252338 - DNA, 27 bp, Artificial sequence
  SiRNA target sequence
aaaaggagataagcccatcaagcttct

SEQ ID NO: 252339 - DNA, 27 bp, Artificial sequence
  SiRNA target sequence
aaaggagataagcccatcaagcttcta

SEQ ID NO: 252340 - DNA, 27 bp, Artificial sequence
  SiRNA target sequence
aaggagataagcccatcaagcttctaa

SEQ ID NO: 252341 - DNA, 27 bp, Artificial sequence
  SiRNA target sequence
aggagataagcccatcaagcttctaac

SEQ ID NO: 252342 - DNA, 27 bp, Artificial sequence
  SiRNA target sequence
ggagataagcccatcaagcttctaact

SEQ ID NO: 252343 - DNA, 27 bp, Artificial sequence
  SiRNA target sequence
gagataagcccatcaagcttctaactg

SEQ ID NO: 252344 - DNA, 27 bp, Artificial sequence
  SiRNA target sequence
agataagcccatcaagcttctaactga

SEQ ID NO: 252345 - DNA, 27 bp, Artificial sequence
  SiRNA target sequence
gataagcccatcaagcttctaactgac

SEQ ID NO: 252346 - DNA, 27 bp, Artificial sequence
  SiRNA target sequence
ataagcccatcaagcttctaactgaca

SEQ ID NO: 252347 - DNA, 27 bp, Artificial sequence
  SiRNA target sequence
taagcccatcaagcttctaactgacat

SEQ ID NO: 252348 - DNA, 27 bp, Artificial sequence
  SiRNA target sequence
aagcccatcaagcttctaactgacatc

SEQ ID NO: 252349 - DNA, 27 bp, Artificial sequence
  SiRNA target sequence
agcccatcaagcttctaactgacatct

SEQ ID NO: 252350 - DNA, 27 bp, Artificial sequence
  SiRNA target sequence
gcccatcaagcttctaactgacatctt

SEQ ID NO: 252351 - DNA, 27 bp, Artificial sequence
  SiRNA target sequence
cccatcaagcttctaactgacatctta

SEQ ID NO: 252352 - DNA, 27 bp, Artificial sequence
  SiRNA target sequence
ccatcaagcttctaactgacatcttac

SEQ ID NO: 252353 - DNA, 27 bp, Artificial sequence
  SiRNA target sequence
catcaagcttctaactgacatcttacc

SEQ ID NO: 252354 - DNA, 27 bp, Artificial sequence
  SiRNA target sequence
atcaagcttctaactgacatcttacca

SEQ ID NO: 252355 - DNA, 27 bp, Artificial sequence
  SiRNA target sequence
tcaagcttctaactgacatcttaccat

SEQ ID NO: 252356 - DNA, 27 bp, Artificial sequence
  SiRNA target sequence
caagcttctaactgacatcttaccatc

SEQ ID NO: 252357 - DNA, 27 bp, Artificial sequence
  SiRNA target sequence
aagcttctaactgacatcttaccatca

SEQ ID NO: 252358 - DNA, 27 bp, Artificial sequence
  SiRNA target sequence
agcttctaactgacatcttaccatcac

SEQ ID NO: 252359 - DNA, 27 bp, Artificial sequence
  SiRNA target sequence
gcttctaactgacatcttaccatcaca

SEQ ID NO: 252360 - DNA, 27 bp, Artificial sequence
  SiRNA target sequence
cttctaactgacatcttaccatcacaa

SEQ ID NO: 252361 - DNA, 27 bp, Artificial sequence
  SiRNA target sequence
ttctaactgacatcttaccatcacaaa

SEQ ID NO: 252362 - DNA, 27 bp, Artificial sequence
  SiRNA target sequence
tctaactgacatcttaccatcacaaaa

SEQ ID NO: 252363 - DNA, 27 bp, Artificial sequence
  SiRNA target sequence
ctaactgacatcttaccatcacaaaaa

SEQ ID NO: 252364 - DNA, 27 bp, Artificial sequence
  SiRNA target sequence
taactgacatcttaccatcacaaaaaa

SEQ ID NO: 252365 - DNA, 27 bp, Artificial sequence
  SiRNA target sequence
aactgacatcttaccatcacaaaaaat

SEQ ID NO: 252366 - DNA, 27 bp, Artificial sequence
  SiRNA target sequence
actgacatcttaccatcacaaaaaata

SEQ ID NO: 252367 - DNA, 27 bp, Artificial sequence
  SiRNA target sequence
ctgacatcttaccatcacaaaaaatat

SEQ ID NO: 252368 - DNA, 27 bp, Artificial sequence
  SiRNA target sequence
tgacatcttaccatcacaaaaaatatc

SEQ ID NO: 252369 - DNA, 27 bp, Artificial sequence
  SiRNA target sequence
gacatcttaccatcacaaaaaatatct

SEQ ID NO: 252370 - DNA, 27 bp, Artificial sequence
  SiRNA target sequence
acatcttaccatcacaaaaaatatcta

SEQ ID NO: 252371 - DNA, 27 bp, Artificial sequence
  SiRNA target sequence
catcttaccatcacaaaaaatatctag

SEQ ID NO: 252372 - DNA, 27 bp, Artificial sequence
  SiRNA target sequence
atcttaccatcacaaaaaatatctagt

SEQ ID NO: 252373 - DNA, 27 bp, Artificial sequence
  SiRNA target sequence
tcttaccatcacaaaaaatatctagtg

SEQ ID NO: 252374 - DNA, 27 bp, Artificial sequence
  SiRNA target sequence
cttaccatcacaaaaaatatctagtgc

SEQ ID NO: 252375 - DNA, 27 bp, Artificial sequence
  SiRNA target sequence
ttaccatcacaaaaaatatctagtgcc

SEQ ID NO: 252376 - DNA, 27 bp, Artificial sequence
  SiRNA target sequence
taccatcacaaaaaatatctagtgccc

SEQ ID NO: 252377 - DNA, 27 bp, Artificial sequence
  SiRNA target sequence
accatcacaaaaaatatctagtgccca

SEQ ID NO: 252378 - DNA, 27 bp, Artificial sequence
  SiRNA target sequence
ccatcacaaaaaatatctagtgcccat

SEQ ID NO: 252379 - DNA, 27 bp, Artificial sequence
  SiRNA target sequence
catcacaaaaaatatctagtgcccatt

SEQ ID NO: 252380 - DNA, 27 bp, Artificial sequence
  SiRNA target sequence
atcacaaaaaatatctagtgcccattg

SEQ ID NO: 252381 - DNA, 27 bp, Artificial sequence
  SiRNA target sequence
tcacaaaaaatatctagtgcccattgt

SEQ ID NO: 252382 - DNA, 27 bp, Artificial sequence
  SiRNA target sequence
cacaaaaaatatctagtgcccattgtg

SEQ ID NO: 252383 - DNA, 27 bp, Artificial sequence
  SiRNA target sequence
acaaaaaatatctagtgcccattgtga

SEQ ID NO: 252384 - DNA, 27 bp, Artificial sequence
  SiRNA target sequence
caaaaaatatctagtgcccattgtgat

SEQ ID NO: 252385 - DNA, 27 bp, Artificial sequence
  SiRNA target sequence
aaaaaatatctagtgcccattgtgatc

SEQ ID NO: 252386 - DNA, 27 bp, Artificial sequence
  SiRNA target sequence
aaaaatatctagtgcccattgtgatcc

SEQ ID NO: 252387 - DNA, 27 bp, Artificial sequence
  SiRNA target sequence
aaaatatctagtgcccattgtgatcct

SEQ ID NO: 252388 - DNA, 27 bp, Artificial sequence
  SiRNA target sequence
aaatatctagtgcccattgtgatcctt

SEQ ID NO: 252389 - DNA, 27 bp, Artificial sequence
  SiRNA target sequence
aatatctagtgcccattgtgatccttt

SEQ ID NO: 252390 - DNA, 27 bp, Artificial sequence
  SiRNA target sequence
atatctagtgcccattgtgatcctttt

SEQ ID NO: 252391 - DNA, 27 bp, Artificial sequence
  SiRNA target sequence
tatctagtgcccattgtgatccttttt

SEQ ID NO: 252392 - DNA, 27 bp, Artificial sequence
  SiRNA target sequence
atctagtgcccattgtgatcctttttg

SEQ ID NO: 252393 - DNA, 27 bp, Artificial sequence
  SiRNA target sequence
tctagtgcccattgtgatcctttttgg

SEQ ID NO: 252394 - DNA, 27 bp, Artificial sequence
  SiRNA target sequence
ctagtgcccattgtgatcctttttgga

SEQ ID NO: 252395 - DNA, 27 bp, Artificial sequence
  SiRNA target sequence
tagtgcccattgtgatcctttttggat

SEQ ID NO: 252396 - DNA, 27 bp, Artificial sequence
  SiRNA target sequence
agtgcccattgtgatcctttttggatt

SEQ ID NO: 252397 - DNA, 27 bp, Artificial sequence
  SiRNA target sequence
gtgcccattgtgatcctttttggattt

SEQ ID NO: 252398 - DNA, 27 bp, Artificial sequence
  SiRNA target sequence
tgcccattgtgatcctttttggatttt

SEQ ID NO: 252399 - DNA, 27 bp, Artificial sequence
  SiRNA target sequence
gcccattgtgatcctttttggatttta

SEQ ID NO: 252400 - DNA, 27 bp, Artificial sequence
  SiRNA target sequence
cccattgtgatcctttttggattttat

SEQ ID NO: 252401 - DNA, 27 bp, Artificial sequence
  SiRNA target sequence
ccattgtgatcctttttggattttata

SEQ ID NO: 252402 - DNA, 27 bp, Artificial sequence
  SiRNA target sequence
cattgtgatcctttttggattttatat

SEQ ID NO: 252403 - DNA, 27 bp, Artificial sequence
  SiRNA target sequence
attgtgatcctttttggattttatatt

SEQ ID NO: 252404 - DNA, 27 bp, Artificial sequence
  SiRNA target sequence
ttgtgatcctttttggattttatattc

SEQ ID NO: 252405 - DNA, 27 bp, Artificial sequence
  SiRNA target sequence
tgtgatcctttttggattttatattca

SEQ ID NO: 252406 - DNA, 27 bp, Artificial sequence
  SiRNA target sequence
gtgatcctttttggattttatattcaa

SEQ ID NO: 252407 - DNA, 27 bp, Artificial sequence
  SiRNA target sequence
tgatcctttttggattttatattcaaa

SEQ ID NO: 252408 - DNA, 27 bp, Artificial sequence
  SiRNA target sequence
gatcctttttggattttatattcaaat

SEQ ID NO: 252409 - DNA, 27 bp, Artificial sequence
  SiRNA target sequence
atcctttttggattttatattcaaatg

SEQ ID NO: 252410 - DNA, 27 bp, Artificial sequence
  SiRNA target sequence
tcctttttggattttatattcaaatgg

SEQ ID NO: 252411 - DNA, 27 bp, Artificial sequence
  SiRNA target sequence
cctttttggattttatattcaaatgga

SEQ ID NO: 252412 - DNA, 27 bp, Artificial sequence
  SiRNA target sequence
ctttttggattttatattcaaatggaa

SEQ ID NO: 252413 - DNA, 27 bp, Artificial sequence
  SiRNA target sequence
tttttggattttatattcaaatggaat

SEQ ID NO: 252414 - DNA, 27 bp, Artificial sequence
  SiRNA target sequence
ttttggattttatattcaaatggaatt

SEQ ID NO: 252415 - DNA, 27 bp, Artificial sequence
  SiRNA target sequence
tttggattttatattcaaatggaatta

SEQ ID NO: 252416 - DNA, 27 bp, Artificial sequence
  SiRNA target sequence
ttggattttatattcaaatggaattaa

SEQ ID NO: 252417 - DNA, 27 bp, Artificial sequence
  SiRNA target sequence
tggattttatattcaaatggaattaaa

SEQ ID NO: 252418 - DNA, 27 bp, Artificial sequence
  SiRNA target sequence
ggattttatattcaaatggaattaaaa

SEQ ID NO: 252419 - DNA, 27 bp, Artificial sequence
  SiRNA target sequence
gattttatattcaaatggaattaaaag

SEQ ID NO: 252420 - DNA, 27 bp, Artificial sequence
  SiRNA target sequence
attttatattcaaatggaattaaaaga

SEQ ID NO: 252421 - DNA, 27 bp, Artificial sequence
  SiRNA target sequence
ttttatattcaaatggaattaaaagag

SEQ ID NO: 252422 - DNA, 27 bp, Artificial sequence
  SiRNA target sequence
tttatattcaaatggaattaaaagaga

SEQ ID NO: 252423 - DNA, 27 bp, Artificial sequence
  SiRNA target sequence
ttatattcaaatggaattaaaagagaa

SEQ ID NO: 252424 - DNA, 27 bp, Artificial sequence
  SiRNA target sequence
tatattcaaatggaattaaaagagaac

SEQ ID NO: 252425 - DNA, 27 bp, Artificial sequence
  SiRNA target sequence
atattcaaatggaattaaaagagaacc

SEQ ID NO: 252426 - DNA, 27 bp, Artificial sequence
  SiRNA target sequence
tattcaaatggaattaaaagagaacca

SEQ ID NO: 252427 - DNA, 27 bp, Artificial sequence
  SiRNA target sequence
attcaaatggaattaaaagagaaccaa

SEQ ID NO: 252428 - DNA, 27 bp, Artificial sequence
  SiRNA target sequence
ttcaaatggaattaaaagagaaccaat

SEQ ID NO: 252429 - DNA, 27 bp, Artificial sequence
  SiRNA target sequence
tcaaatggaattaaaagagaaccaatt

SEQ ID NO: 252430 - DNA, 27 bp, Artificial sequence
  SiRNA target sequence
caaatggaattaaaagagaaccaatta

SEQ ID NO: 252431 - DNA, 27 bp, Artificial sequence
  SiRNA target sequence
aaatggaattaaaagagaaccaattag

SEQ ID NO: 252432 - DNA, 27 bp, Artificial sequence
  SiRNA target sequence
aatggaattaaaagagaaccaattaga

SEQ ID NO: 252433 - DNA, 27 bp, Artificial sequence
  SiRNA target sequence
atggaattaaaagagaaccaattagaa

SEQ ID NO: 252434 - DNA, 27 bp, Artificial sequence
  SiRNA target sequence
tggaattaaaagagaaccaattagaaa

SEQ ID NO: 252435 - DNA, 27 bp, Artificial sequence
  SiRNA target sequence
ggaattaaaagagaaccaattagaaaa

SEQ ID NO: 252436 - DNA, 27 bp, Artificial sequence
  SiRNA target sequence
gaattaaaagagaaccaattagaaaaa

SEQ ID NO: 252437 - DNA, 27 bp, Artificial sequence
  SiRNA target sequence
aattaaaagagaaccaattagaaaaaa

SEQ ID NO: 252438 - DNA, 27 bp, Artificial sequence
  SiRNA target sequence
attaaaagagaaccaattagaaaaaaa

SEQ ID NO: 252439 - DNA, 27 bp, Artificial sequence
  SiRNA target sequence
ttaaaagagaaccaattagaaaaaaaa

SEQ ID NO: 252440 - DNA, 27 bp, Artificial sequence
  SiRNA target sequence
taaaagagaaccaattagaaaaaaaat

SEQ ID NO: 252441 - DNA, 27 bp, Artificial sequence
  SiRNA target sequence
aaaagagaaccaattagaaaaaaaatg

SEQ ID NO: 252442 - DNA, 27 bp, Artificial sequence
  SiRNA target sequence
aaagagaaccaattagaaaaaaaatgc

SEQ ID NO: 252443 - DNA, 27 bp, Artificial sequence
  SiRNA target sequence
aagagaaccaattagaaaaaaaatgcc

SEQ ID NO: 252444 - DNA, 27 bp, Artificial sequence
  SiRNA target sequence
agagaaccaattagaaaaaaaatgcca

SEQ ID NO: 252445 - DNA, 27 bp, Artificial sequence
  SiRNA target sequence
gagaaccaattagaaaaaaaatgccaa

SEQ ID NO: 252446 - DNA, 27 bp, Artificial sequence
  SiRNA target sequence
agaaccaattagaaaaaaaatgccaat

SEQ ID NO: 252447 - DNA, 27 bp, Artificial sequence
  SiRNA target sequence
gaaccaattagaaaaaaaatgccaata

SEQ ID NO: 252448 - DNA, 27 bp, Artificial sequence
  SiRNA target sequence
aaccaattagaaaaaaaatgccaataa

SEQ ID NO: 252449 - DNA, 27 bp, Artificial sequence
  SiRNA target sequence
accaattagaaaaaaaatgccaataaa

SEQ ID NO: 252450 - DNA, 27 bp, Artificial sequence
  SiRNA target sequence
ccaattagaaaaaaaatgccaataaaa

SEQ ID NO: 252451 - DNA, 27 bp, Artificial sequence
  SiRNA target sequence
caattagaaaaaaaatgccaataaaac

SEQ ID NO: 252452 - DNA, 27 bp, Artificial sequence
  SiRNA target sequence
aattagaaaaaaaatgccaataaaacc

SEQ ID NO: 252453 - DNA, 27 bp, Artificial sequence
  SiRNA target sequence
attagaaaaaaaatgccaataaaacca

SEQ ID NO: 252454 - DNA, 27 bp, Artificial sequence
  SiRNA target sequence
ttagaaaaaaaatgccaataaaaccaa

SEQ ID NO: 252455 - DNA, 27 bp, Artificial sequence
  SiRNA target sequence
tagaaaaaaaatgccaataaaaccaaa

SEQ ID NO: 252456 - DNA, 27 bp, Artificial sequence
  SiRNA target sequence
agaaaaaaaatgccaataaaaccaaaa

SEQ ID NO: 252457 - DNA, 27 bp, Artificial sequence
  SiRNA target sequence
gaaaaaaaatgccaataaaaccaaaaa

SEQ ID NO: 252458 - DNA, 27 bp, Artificial sequence
  SiRNA target sequence
aaaaaaaatgccaataaaaccaaaaat

SEQ ID NO: 252459 - DNA, 27 bp, Artificial sequence
  SiRNA target sequence
aaaaaaatgccaataaaaccaaaaata

SEQ ID NO: 252460 - DNA, 27 bp, Artificial sequence
  SiRNA target sequence
aaaaaatgccaataaaaccaaaaataa

SEQ ID NO: 252461 - DNA, 27 bp, Artificial sequence
  SiRNA target sequence
aaaaatgccaataaaaccaaaaataat

SEQ ID NO: 252462 - DNA, 27 bp, Artificial sequence
  SiRNA target sequence
aaaatgccaataaaaccaaaaataata

SEQ ID NO: 252463 - DNA, 27 bp, Artificial sequence
  SiRNA target sequence
aaatgccaataaaaccaaaaataataa

SEQ ID NO: 252464 - DNA, 27 bp, Artificial sequence
  SiRNA target sequence
aatgccaataaaaccaaaaataataaa

SEQ ID NO: 252465 - DNA, 27 bp, Artificial sequence
  SiRNA target sequence
atgccaataaaaccaaaaataataaaa

SEQ ID NO: 252466 - DNA, 27 bp, Artificial sequence
  SiRNA target sequence
tgccaataaaaccaaaaataataaaat

SEQ ID NO: 252467 - DNA, 27 bp, Artificial sequence
  SiRNA target sequence
gccaataaaaccaaaaataataaaatt

SEQ ID NO: 252468 - DNA, 27 bp, Artificial sequence
  SiRNA target sequence
ccaataaaaccaaaaataataaaattc

SEQ ID NO: 252469 - DNA, 27 bp, Artificial sequence
  SiRNA target sequence
caataaaaccaaaaataataaaattca

SEQ ID NO: 252470 - DNA, 27 bp, Artificial sequence
  SiRNA target sequence
aataaaaccaaaaataataaaattcac

SEQ ID NO: 252471 - DNA, 27 bp, Artificial sequence
  SiRNA target sequence
ataaaaccaaaaataataaaattcaca

SEQ ID NO: 252472 - DNA, 27 bp, Artificial sequence
  SiRNA target sequence
taaaaccaaaaataataaaattcacaa

SEQ ID NO: 252473 - DNA, 27 bp, Artificial sequence
  SiRNA target sequence
aaaaccaaaaataataaaattcacaat

SEQ ID NO: 252474 - DNA, 27 bp, Artificial sequence
  SiRNA target sequence
aaaccaaaaataataaaattcacaata

SEQ ID NO: 252475 - DNA, 27 bp, Artificial sequence
  SiRNA target sequence
aaccaaaaataataaaattcacaatac

SEQ ID NO: 252476 - DNA, 27 bp, Artificial sequence
  SiRNA target sequence
accaaaaataataaaattcacaatact

SEQ ID NO: 252477 - DNA, 27 bp, Artificial sequence
  SiRNA target sequence
ccaaaaataataaaattcacaatacta

SEQ ID NO: 252478 - DNA, 27 bp, Artificial sequence
  SiRNA target sequence
caaaaataataaaattcacaatactaa

SEQ ID NO: 252479 - DNA, 27 bp, Artificial sequence
  SiRNA target sequence
aaaaataataaaattcacaatactaag

SEQ ID NO: 252480 - DNA, 27 bp, Artificial sequence
  SiRNA target sequence
aaaataataaaattcacaatactaaga

SEQ ID NO: 252481 - DNA, 27 bp, Artificial sequence
  SiRNA target sequence
aaataataaaattcacaatactaagaa

SEQ ID NO: 252482 - DNA, 27 bp, Artificial sequence
  SiRNA target sequence
aataataaaattcacaatactaagaat

SEQ ID NO: 252483 - DNA, 27 bp, Artificial sequence
  SiRNA target sequence
ataataaaattcacaatactaagaata

SEQ ID NO: 252484 - DNA, 27 bp, Artificial sequence
  SiRNA target sequence
taataaaattcacaatactaagaatag

SEQ ID NO: 252485 - DNA, 27 bp, Artificial sequence
  SiRNA target sequence
aataaaattcacaatactaagaataga

SEQ ID NO: 252486 - DNA, 27 bp, Artificial sequence
  SiRNA target sequence
ataaaattcacaatactaagaatagag

SEQ ID NO: 252487 - DNA, 27 bp, Artificial sequence
  SiRNA target sequence
taaaattcacaatactaagaatagagt

SEQ ID NO: 252488 - DNA, 27 bp, Artificial sequence
  SiRNA target sequence
aaaattcacaatactaagaatagagta

SEQ ID NO: 252489 - DNA, 27 bp, Artificial sequence
  SiRNA target sequence
aaattcacaatactaagaatagagtac

SEQ ID NO: 252490 - DNA, 27 bp, Artificial sequence
  SiRNA target sequence
aattcacaatactaagaatagagtaca

SEQ ID NO: 252491 - DNA, 27 bp, Artificial sequence
  SiRNA target sequence
attcacaatactaagaatagagtacac

SEQ ID NO: 252492 - DNA, 27 bp, Artificial sequence
  SiRNA target sequence
ttcacaatactaagaatagagtacaca

SEQ ID NO: 252493 - DNA, 27 bp, Artificial sequence
  SiRNA target sequence
tcacaatactaagaatagagtacacat

SEQ ID NO: 252494 - DNA, 27 bp, Artificial sequence
  SiRNA target sequence
cacaatactaagaatagagtacacatt

SEQ ID NO: 252495 - DNA, 27 bp, Artificial sequence
  SiRNA target sequence
acaatactaagaatagagtacacattt

SEQ ID NO: 252496 - DNA, 27 bp, Artificial sequence
  SiRNA target sequence
caatactaagaatagagtacacattta

SEQ ID NO: 252497 - DNA, 27 bp, Artificial sequence
  SiRNA target sequence
aatactaagaatagagtacacatttaa

SEQ ID NO: 252498 - DNA, 27 bp, Artificial sequence
  SiRNA target sequence
atactaagaatagagtacacatttaaa

SEQ ID NO: 252499 - DNA, 27 bp, Artificial sequence
  SiRNA target sequence
tactaagaatagagtacacatttaaag

SEQ ID NO: 252500 - DNA, 27 bp, Artificial sequence
  SiRNA target sequence
actaagaatagagtacacatttaaagc

SEQ ID NO: 252501 - DNA, 27 bp, Artificial sequence
  SiRNA target sequence
ctaagaatagagtacacatttaaagcc

SEQ ID NO: 252502 - DNA, 27 bp, Artificial sequence
  SiRNA target sequence
taagaatagagtacacatttaaagcct

SEQ ID NO: 252503 - DNA, 27 bp, Artificial sequence
  SiRNA target sequence
aagaatagagtacacatttaaagcctt

SEQ ID NO: 252504 - DNA, 27 bp, Artificial sequence
  SiRNA target sequence
agaatagagtacacatttaaagccttt

SEQ ID NO: 252505 - DNA, 27 bp, Artificial sequence
  SiRNA target sequence
gaatagagtacacatttaaagcctttt

SEQ ID NO: 252506 - DNA, 27 bp, Artificial sequence
  SiRNA target sequence
aatagagtacacatttaaagccttttg

SEQ ID NO: 252507 - DNA, 27 bp, Artificial sequence
  SiRNA target sequence
atagagtacacatttaaagccttttgg

SEQ ID NO: 252508 - DNA, 27 bp, Artificial sequence
  SiRNA target sequence
tagagtacacatttaaagccttttgga

SEQ ID NO: 252509 - DNA, 27 bp, Artificial sequence
  SiRNA target sequence
agagtacacatttaaagccttttggac

SEQ ID NO: 252510 - DNA, 27 bp, Artificial sequence
  SiRNA target sequence
gagtacacatttaaagccttttggaca

SEQ ID NO: 252511 - DNA, 27 bp, Artificial sequence
  SiRNA target sequence
agtacacatttaaagccttttggacat

SEQ ID NO: 252512 - DNA, 27 bp, Artificial sequence
  SiRNA target sequence
gtacacatttaaagccttttggacata

SEQ ID NO: 252513 - DNA, 27 bp, Artificial sequence
  SiRNA target sequence
tacacatttaaagccttttggacatat

SEQ ID NO: 252514 - DNA, 27 bp, Artificial sequence
  SiRNA target sequence
acacatttaaagccttttggacatatg

SEQ ID NO: 252515 - DNA, 27 bp, Artificial sequence
  SiRNA target sequence
cacatttaaagccttttggacatatga

SEQ ID NO: 252516 - DNA, 27 bp, Artificial sequence
  SiRNA target sequence
acatttaaagccttttggacatatgac

SEQ ID NO: 252517 - DNA, 27 bp, Artificial sequence
  SiRNA target sequence
catttaaagccttttggacatatgaca

SEQ ID NO: 252518 - DNA, 27 bp, Artificial sequence
  SiRNA target sequence
atttaaagccttttggacatatgacat

SEQ ID NO: 252519 - DNA, 27 bp, Artificial sequence
  SiRNA target sequence
tttaaagccttttggacatatgacatc

SEQ ID NO: 252520 - DNA, 27 bp, Artificial sequence
  SiRNA target sequence
ttaaagccttttggacatatgacatca

SEQ ID NO: 252521 - DNA, 27 bp, Artificial sequence
  SiRNA target sequence
taaagccttttggacatatgacatcat

SEQ ID NO: 252522 - DNA, 27 bp, Artificial sequence
  SiRNA target sequence
aaagccttttggacatatgacatcata

SEQ ID NO: 252523 - DNA, 27 bp, Artificial sequence
  SiRNA target sequence
aagccttttggacatatgacatcataa

SEQ ID NO: 252524 - DNA, 27 bp, Artificial sequence
  SiRNA target sequence
agccttttggacatatgacatcataag

SEQ ID NO: 252525 - DNA, 27 bp, Artificial sequence
  SiRNA target sequence
gccttttggacatatgacatcataaga

SEQ ID NO: 252526 - DNA, 27 bp, Artificial sequence
  SiRNA target sequence
ccttttggacatatgacatcataagac

SEQ ID NO: 252527 - DNA, 27 bp, Artificial sequence
  SiRNA target sequence
cttttggacatatgacatcataagaca

SEQ ID NO: 252528 - DNA, 27 bp, Artificial sequence
  SiRNA target sequence
ttttggacatatgacatcataagacat

SEQ ID NO: 252529 - DNA, 27 bp, Artificial sequence
  SiRNA target sequence
tttggacatatgacatcataagacata

SEQ ID NO: 252530 - DNA, 27 bp, Artificial sequence
  SiRNA target sequence
ttggacatatgacatcataagacatat

SEQ ID NO: 252531 - DNA, 27 bp, Artificial sequence
  SiRNA target sequence
tggacatatgacatcataagacatata

SEQ ID NO: 252532 - DNA, 27 bp, Artificial sequence
  SiRNA target sequence
ggacatatgacatcataagacatataa

SEQ ID NO: 252533 - DNA, 27 bp, Artificial sequence
  SiRNA target sequence
gacatatgacatcataagacatataat

SEQ ID NO: 252534 - DNA, 27 bp, Artificial sequence
  SiRNA target sequence
acatatgacatcataagacatataatt

SEQ ID NO: 252535 - DNA, 27 bp, Artificial sequence
  SiRNA target sequence
catatgacatcataagacatataattg

SEQ ID NO: 252536 - DNA, 27 bp, Artificial sequence
  SiRNA target sequence
atatgacatcataagacatataattgg

SEQ ID NO: 252537 - DNA, 27 bp, Artificial sequence
  SiRNA target sequence
tatgacatcataagacatataattggc

SEQ ID NO: 252538 - DNA, 27 bp, Artificial sequence
  SiRNA target sequence
atgacatcataagacatataattggca

SEQ ID NO: 252539 - DNA, 27 bp, Artificial sequence
  SiRNA target sequence
tgacatcataagacatataattggcag

SEQ ID NO: 252540 - DNA, 27 bp, Artificial sequence
  SiRNA target sequence
gacatcataagacatataattggcagt

SEQ ID NO: 252541 - DNA, 27 bp, Artificial sequence
  SiRNA target sequence
acatcataagacatataattggcagtg

SEQ ID NO: 252542 - DNA, 27 bp, Artificial sequence
  SiRNA target sequence
catcataagacatataattggcagtga

SEQ ID NO: 252543 - DNA, 27 bp, Artificial sequence
  SiRNA target sequence
atcataagacatataattggcagtgaa

SEQ ID NO: 252544 - DNA, 27 bp, Artificial sequence
  SiRNA target sequence
tcataagacatataattggcagtgaaa

SEQ ID NO: 252545 - DNA, 27 bp, Artificial sequence
  SiRNA target sequence
cataagacatataattggcagtgaaaa

SEQ ID NO: 252546 - DNA, 27 bp, Artificial sequence
  SiRNA target sequence
ataagacatataattggcagtgaaaag

SEQ ID NO: 252547 - DNA, 27 bp, Artificial sequence
  SiRNA target sequence
taagacatataattggcagtgaaaaga

SEQ ID NO: 252548 - DNA, 27 bp, Artificial sequence
  SiRNA target sequence
aagacatataattggcagtgaaaagaa

SEQ ID NO: 252549 - DNA, 27 bp, Artificial sequence
  SiRNA target sequence
agacatataattggcagtgaaaagaaa

SEQ ID NO: 252550 - DNA, 27 bp, Artificial sequence
  SiRNA target sequence
gacatataattggcagtgaaaagaaaa

SEQ ID NO: 252551 - DNA, 27 bp, Artificial sequence
  SiRNA target sequence
acatataattggcagtgaaaagaaaag

SEQ ID NO: 252552 - DNA, 27 bp, Artificial sequence
  SiRNA target sequence
catataattggcagtgaaaagaaaagc

SEQ ID NO: 252553 - DNA, 27 bp, Artificial sequence
  SiRNA target sequence
atataattggcagtgaaaagaaaagct

SEQ ID NO: 252554 - DNA, 27 bp, Artificial sequence
  SiRNA target sequence
tataattggcagtgaaaagaaaagctt

SEQ ID NO: 252555 - DNA, 27 bp, Artificial sequence
  SiRNA target sequence
ataattggcagtgaaaagaaaagcttt

SEQ ID NO: 252556 - DNA, 27 bp, Artificial sequence
  SiRNA target sequence
taattggcagtgaaaagaaaagcttta

SEQ ID NO: 252557 - DNA, 27 bp, Artificial sequence
  SiRNA target sequence
aattggcagtgaaaagaaaagctttat

SEQ ID NO: 252558 - DNA, 27 bp, Artificial sequence
  SiRNA target sequence
attggcagtgaaaagaaaagctttatg

SEQ ID NO: 252559 - DNA, 27 bp, Artificial sequence
  SiRNA target sequence
ttggcagtgaaaagaaaagctttatgt

SEQ ID NO: 252560 - DNA, 27 bp, Artificial sequence
  SiRNA target sequence
tggcagtgaaaagaaaagctttatgta

SEQ ID NO: 252561 - DNA, 27 bp, Artificial sequence
  SiRNA target sequence
ggcagtgaaaagaaaagctttatgtag

SEQ ID NO: 252562 - DNA, 27 bp, Artificial sequence
  SiRNA target sequence
gcagtgaaaagaaaagctttatgtagt

SEQ ID NO: 252563 - DNA, 27 bp, Artificial sequence
  SiRNA target sequence
cagtgaaaagaaaagctttatgtagta

SEQ ID NO: 252564 - DNA, 27 bp, Artificial sequence
  SiRNA target sequence
agtgaaaagaaaagctttatgtagtac

SEQ ID NO: 252565 - DNA, 27 bp, Artificial sequence
  SiRNA target sequence
gtgaaaagaaaagctttatgtagtaca

SEQ ID NO: 252566 - DNA, 27 bp, Artificial sequence
  SiRNA target sequence
tgaaaagaaaagctttatgtagtacag

SEQ ID NO: 252567 - DNA, 27 bp, Artificial sequence
  SiRNA target sequence
gaaaagaaaagctttatgtagtacagt

SEQ ID NO: 252568 - DNA, 27 bp, Artificial sequence
  SiRNA target sequence
aaaagaaaagctttatgtagtacagtg

SEQ ID NO: 252569 - DNA, 27 bp, Artificial sequence
  SiRNA target sequence
aaagaaaagctttatgtagtacagtga

SEQ ID NO: 252570 - DNA, 27 bp, Artificial sequence
  SiRNA target sequence
aagaaaagctttatgtagtacagtgac

SEQ ID NO: 252571 - DNA, 27 bp, Artificial sequence
  SiRNA target sequence
agaaaagctttatgtagtacagtgacg

SEQ ID NO: 252572 - DNA, 27 bp, Artificial sequence
  SiRNA target sequence
gaaaagctttatgtagtacagtgacga

SEQ ID NO: 252573 - DNA, 27 bp, Artificial sequence
  SiRNA target sequence
aaaagctttatgtagtacagtgacgaa

SEQ ID NO: 252574 - DNA, 27 bp, Artificial sequence
  SiRNA target sequence
aaagctttatgtagtacagtgacgaag

SEQ ID NO: 252575 - DNA, 27 bp, Artificial sequence
  SiRNA target sequence
aagctttatgtagtacagtgacgaagg

SEQ ID NO: 252576 - DNA, 27 bp, Artificial sequence
  SiRNA target sequence
agctttatgtagtacagtgacgaagga

SEQ ID NO: 252577 - DNA, 27 bp, Artificial sequence
  SiRNA target sequence
gctttatgtagtacagtgacgaaggaa

SEQ ID NO: 252578 - DNA, 27 bp, Artificial sequence
  SiRNA target sequence
ctttatgtagtacagtgacgaaggaat

SEQ ID NO: 252579 - DNA, 27 bp, Artificial sequence
  SiRNA target sequence
tttatgtagtacagtgacgaaggaatt

SEQ ID NO: 252580 - DNA, 27 bp, Artificial sequence
  SiRNA target sequence
ttatgtagtacagtgacgaaggaattt

SEQ ID NO: 252581 - DNA, 27 bp, Artificial sequence
  SiRNA target sequence
tatgtagtacagtgacgaaggaatttg

SEQ ID NO: 252582 - DNA, 27 bp, Artificial sequence
  SiRNA target sequence
atgtagtacagtgacgaaggaatttgt

SEQ ID NO: 252583 - DNA, 27 bp, Artificial sequence
  SiRNA target sequence
tgtagtacagtgacgaaggaatttgtt

SEQ ID NO: 252584 - DNA, 27 bp, Artificial sequence
  SiRNA target sequence
gtagtacagtgacgaaggaatttgttt

SEQ ID NO: 252585 - DNA, 27 bp, Artificial sequence
  SiRNA target sequence
tagtacagtgacgaaggaatttgtttt

SEQ ID NO: 252586 - DNA, 27 bp, Artificial sequence
  SiRNA target sequence
agtacagtgacgaaggaatttgttttg

SEQ ID NO: 252587 - DNA, 27 bp, Artificial sequence
  SiRNA target sequence
gtacagtgacgaaggaatttgttttgt

SEQ ID NO: 252588 - DNA, 27 bp, Artificial sequence
  SiRNA target sequence
tacagtgacgaaggaatttgttttgtc

SEQ ID NO: 252589 - DNA, 27 bp, Artificial sequence
  SiRNA target sequence
acagtgacgaaggaatttgttttgtca

SEQ ID NO: 252590 - DNA, 27 bp, Artificial sequence
  SiRNA target sequence
cagtgacgaaggaatttgttttgtcat

SEQ ID NO: 252591 - DNA, 27 bp, Artificial sequence
  SiRNA target sequence
agtgacgaaggaatttgttttgtcata

SEQ ID NO: 252592 - DNA, 27 bp, Artificial sequence
  SiRNA target sequence
gtgacgaaggaatttgttttgtcataa

SEQ ID NO: 252593 - DNA, 27 bp, Artificial sequence
  SiRNA target sequence
tgacgaaggaatttgttttgtcataat

SEQ ID NO: 252594 - DNA, 27 bp, Artificial sequence
  SiRNA target sequence
gacgaaggaatttgttttgtcataatc

SEQ ID NO: 252595 - DNA, 27 bp, Artificial sequence
  SiRNA target sequence
acgaaggaatttgttttgtcataatca

SEQ ID NO: 252596 - DNA, 27 bp, Artificial sequence
  SiRNA target sequence
cgaaggaatttgttttgtcataatcac

SEQ ID NO: 252597 - DNA, 27 bp, Artificial sequence
  SiRNA target sequence
gaaggaatttgttttgtcataatcacg

SEQ ID NO: 252598 - DNA, 27 bp, Artificial sequence
  SiRNA target sequence
aaggaatttgttttgtcataatcacga

SEQ ID NO: 252599 - DNA, 27 bp, Artificial sequence
  SiRNA target sequence
aggaatttgttttgtcataatcacgat

SEQ ID NO: 252600 - DNA, 27 bp, Artificial sequence
  SiRNA target sequence
ggaatttgttttgtcataatcacgatt

SEQ ID NO: 252601 - DNA, 27 bp, Artificial sequence
  SiRNA target sequence
gaatttgttttgtcataatcacgattt

SEQ ID NO: 252602 - DNA, 27 bp, Artificial sequence
  SiRNA target sequence
aatttgttttgtcataatcacgatttc

SEQ ID NO: 252603 - DNA, 27 bp, Artificial sequence
  SiRNA target sequence
atttgttttgtcataatcacgatttct

SEQ ID NO: 252604 - DNA, 27 bp, Artificial sequence
  SiRNA target sequence
tttgttttgtcataatcacgatttctc

SEQ ID NO: 252605 - DNA, 27 bp, Artificial sequence
  SiRNA target sequence
ttgttttgtcataatcacgatttctct

SEQ ID NO: 252606 - DNA, 27 bp, Artificial sequence
  SiRNA target sequence
tgttttgtcataatcacgatttctctg

SEQ ID NO: 252607 - DNA, 27 bp, Artificial sequence
  SiRNA target sequence
gttttgtcataatcacgatttctctgt

SEQ ID NO: 252608 - DNA, 27 bp, Artificial sequence
  SiRNA target sequence
ttttgtcataatcacgatttctctgta

SEQ ID NO: 252609 - DNA, 27 bp, Artificial sequence
  SiRNA target sequence
tttgtcataatcacgatttctctgtaa

SEQ ID NO: 252610 - DNA, 27 bp, Artificial sequence
  SiRNA target sequence
ttgtcataatcacgatttctctgtaaa

SEQ ID NO: 252611 - DNA, 27 bp, Artificial sequence
  SiRNA target sequence
tgtcataatcacgatttctctgtaaaa

SEQ ID NO: 252612 - DNA, 27 bp, Artificial sequence
  SiRNA target sequence
gtcataatcacgatttctctgtaaaat

SEQ ID NO: 252613 - DNA, 27 bp, Artificial sequence
  SiRNA target sequence
tcataatcacgatttctctgtaaaatt

SEQ ID NO: 252614 - DNA, 27 bp, Artificial sequence
  SiRNA target sequence
cataatcacgatttctctgtaaaattc

SEQ ID NO: 252615 - DNA, 27 bp, Artificial sequence
  SiRNA target sequence
ataatcacgatttctctgtaaaattcc

SEQ ID NO: 252616 - DNA, 27 bp, Artificial sequence
  SiRNA target sequence
taatcacgatttctctgtaaaattcca

SEQ ID NO: 252617 - DNA, 27 bp, Artificial sequence
  SiRNA target sequence
aatcacgatttctctgtaaaattccaa

SEQ ID NO: 252618 - DNA, 27 bp, Artificial sequence
  SiRNA target sequence
atcacgatttctctgtaaaattccaat

SEQ ID NO: 252619 - DNA, 27 bp, Artificial sequence
  SiRNA target sequence
tcacgatttctctgtaaaattccaata

SEQ ID NO: 252620 - DNA, 27 bp, Artificial sequence
  SiRNA target sequence
cacgatttctctgtaaaattccaataa

SEQ ID NO: 252621 - DNA, 27 bp, Artificial sequence
  SiRNA target sequence
acgatttctctgtaaaattccaataat

SEQ ID NO: 252622 - DNA, 27 bp, Artificial sequence
  SiRNA target sequence
cgatttctctgtaaaattccaataatg

SEQ ID NO: 252623 - DNA, 27 bp, Artificial sequence
  SiRNA target sequence
gatttctctgtaaaattccaataatgt

SEQ ID NO: 252624 - DNA, 27 bp, Artificial sequence
  SiRNA target sequence
atttctctgtaaaattccaataatgtg

SEQ ID NO: 252625 - DNA, 27 bp, Artificial sequence
  SiRNA target sequence
tttctctgtaaaattccaataatgtgt

SEQ ID NO: 252626 - DNA, 27 bp, Artificial sequence
  SiRNA target sequence
ttctctgtaaaattccaataatgtgtt

SEQ ID NO: 252627 - DNA, 27 bp, Artificial sequence
  SiRNA target sequence
tctctgtaaaattccaataatgtgtta

SEQ ID NO: 252628 - DNA, 27 bp, Artificial sequence
  SiRNA target sequence
ctctgtaaaattccaataatgtgttaa

SEQ ID NO: 252629 - DNA, 27 bp, Artificial sequence
  SiRNA target sequence
tctgtaaaattccaataatgtgttaat

SEQ ID NO: 252630 - DNA, 27 bp, Artificial sequence
  SiRNA target sequence
ctgtaaaattccaataatgtgttaatc

SEQ ID NO: 252631 - DNA, 27 bp, Artificial sequence
  SiRNA target sequence
tgtaaaattccaataatgtgttaatca

SEQ ID NO: 252632 - DNA, 27 bp, Artificial sequence
  SiRNA target sequence
gtaaaattccaataatgtgttaatcac

SEQ ID NO: 252633 - DNA, 27 bp, Artificial sequence
  SiRNA target sequence
taaaattccaataatgtgttaatcaca

SEQ ID NO: 252634 - DNA, 27 bp, Artificial sequence
  SiRNA target sequence
aaaattccaataatgtgttaatcacac

SEQ ID NO: 252635 - DNA, 27 bp, Artificial sequence
  SiRNA target sequence
aaattccaataatgtgttaatcacaca

SEQ ID NO: 252636 - DNA, 27 bp, Artificial sequence
  SiRNA target sequence
aattccaataatgtgttaatcacacat

SEQ ID NO: 252637 - DNA, 27 bp, Artificial sequence
  SiRNA target sequence
attccaataatgtgttaatcacacatg

SEQ ID NO: 252638 - DNA, 27 bp, Artificial sequence
  SiRNA target sequence
ttccaataatgtgttaatcacacatgc

SEQ ID NO: 252639 - DNA, 27 bp, Artificial sequence
  SiRNA target sequence
tccaataatgtgttaatcacacatgcc

SEQ ID NO: 252640 - DNA, 27 bp, Artificial sequence
  SiRNA target sequence
ccaataatgtgttaatcacacatgcca

SEQ ID NO: 252641 - DNA, 27 bp, Artificial sequence
  SiRNA target sequence
caataatgtgttaatcacacatgccat

SEQ ID NO: 252642 - DNA, 27 bp, Artificial sequence
  SiRNA target sequence
aataatgtgttaatcacacatgccatt

SEQ ID NO: 252643 - DNA, 27 bp, Artificial sequence
  SiRNA target sequence
ataatgtgttaatcacacatgccatta

SEQ ID NO: 252644 - DNA, 27 bp, Artificial sequence
  SiRNA target sequence
taatgtgttaatcacacatgccattaa

SEQ ID NO: 252645 - DNA, 27 bp, Artificial sequence
  SiRNA target sequence
aatgtgttaatcacacatgccattaaa

SEQ ID NO: 252646 - DNA, 27 bp, Artificial sequence
  SiRNA target sequence
atgtgttaatcacacatgccattaaaa

SEQ ID NO: 252647 - DNA, 27 bp, Artificial sequence
  SiRNA target sequence
tgtgttaatcacacatgccattaaaaa

SEQ ID NO: 252648 - DNA, 27 bp, Artificial sequence
  SiRNA target sequence
gtgttaatcacacatgccattaaaaat

SEQ ID NO: 252649 - DNA, 27 bp, Artificial sequence
  SiRNA target sequence
tgttaatcacacatgccattaaaaatg

SEQ ID NO: 252650 - DNA, 27 bp, Artificial sequence
  SiRNA target sequence
gttaatcacacatgccattaaaaatgt

SEQ ID NO: 252651 - DNA, 27 bp, Artificial sequence
  SiRNA target sequence
ttaatcacacatgccattaaaaatgta

SEQ ID NO: 252652 - DNA, 27 bp, Artificial sequence
  SiRNA target sequence
taatcacacatgccattaaaaatgtaa

SEQ ID NO: 252653 - DNA, 27 bp, Artificial sequence
  SiRNA target sequence
aatcacacatgccattaaaaatgtaag

SEQ ID NO: 252654 - DNA, 27 bp, Artificial sequence
  SiRNA target sequence
atcacacatgccattaaaaatgtaagt

SEQ ID NO: 252655 - DNA, 27 bp, Artificial sequence
  SiRNA target sequence
tcacacatgccattaaaaatgtaagtg

SEQ ID NO: 252656 - DNA, 27 bp, Artificial sequence
  SiRNA target sequence
cacacatgccattaaaaatgtaagtga

SEQ ID NO: 252657 - DNA, 27 bp, Artificial sequence
  SiRNA target sequence
acacatgccattaaaaatgtaagtgac

SEQ ID NO: 252658 - DNA, 27 bp, Artificial sequence
  SiRNA target sequence
cacatgccattaaaaatgtaagtgaca

SEQ ID NO: 252659 - DNA, 27 bp, Artificial sequence
  SiRNA target sequence
acatgccattaaaaatgtaagtgacaa

SEQ ID NO: 252660 - DNA, 27 bp, Artificial sequence
  SiRNA target sequence
catgccattaaaaatgtaagtgacaat

SEQ ID NO: 252661 - DNA, 27 bp, Artificial sequence
  SiRNA target sequence
atgccattaaaaatgtaagtgacaata

SEQ ID NO: 252662 - DNA, 27 bp, Artificial sequence
  SiRNA target sequence
tgccattaaaaatgtaagtgacaataa

SEQ ID NO: 252663 - DNA, 27 bp, Artificial sequence
  SiRNA target sequence
gccattaaaaatgtaagtgacaataat

SEQ ID NO: 252664 - DNA, 27 bp, Artificial sequence
  SiRNA target sequence
ccattaaaaatgtaagtgacaataata

SEQ ID NO: 252665 - DNA, 27 bp, Artificial sequence
  SiRNA target sequence
cattaaaaatgtaagtgacaataatat

SEQ ID NO: 252666 - DNA, 27 bp, Artificial sequence
  SiRNA target sequence
attaaaaatgtaagtgacaataatatt

SEQ ID NO: 252667 - DNA, 27 bp, Artificial sequence
  SiRNA target sequence
ttaaaaatgtaagtgacaataatattt

SEQ ID NO: 252668 - DNA, 27 bp, Artificial sequence
  SiRNA target sequence
taaaaatgtaagtgacaataatatttt

SEQ ID NO: 252669 - DNA, 27 bp, Artificial sequence
  SiRNA target sequence
aaaaatgtaagtgacaataatattttt

SEQ ID NO: 252670 - DNA, 27 bp, Artificial sequence
  SiRNA target sequence
aaaatgtaagtgacaataatattttta

SEQ ID NO: 252671 - DNA, 27 bp, Artificial sequence
  SiRNA target sequence
aaatgtaagtgacaataatatttttac

SEQ ID NO: 252672 - DNA, 27 bp, Artificial sequence
  SiRNA target sequence
aatgtaagtgacaataatatttttact

SEQ ID NO: 252673 - DNA, 27 bp, Artificial sequence
  SiRNA target sequence
atgtaagtgacaataatatttttactt

SEQ ID NO: 252674 - DNA, 27 bp, Artificial sequence
  SiRNA target sequence
tgtaagtgacaataatatttttacttt

SEQ ID NO: 252675 - DNA, 27 bp, Artificial sequence
  SiRNA target sequence
gtaagtgacaataatatttttactttt

SEQ ID NO: 252676 - DNA, 27 bp, Artificial sequence
  SiRNA target sequence
taagtgacaataatatttttacttttg

SEQ ID NO: 252677 - DNA, 27 bp, Artificial sequence
  SiRNA target sequence
aagtgacaataatatttttacttttgg

SEQ ID NO: 252678 - DNA, 27 bp, Artificial sequence
  SiRNA target sequence
agtgacaataatatttttacttttggg

SEQ ID NO: 252679 - DNA, 27 bp, Artificial sequence
  SiRNA target sequence
gtgacaataatatttttacttttggga

SEQ ID NO: 252680 - DNA, 27 bp, Artificial sequence
  SiRNA target sequence
tgacaataatatttttacttttgggaa

SEQ ID NO: 252681 - DNA, 27 bp, Artificial sequence
  SiRNA target sequence
gacaataatatttttacttttgggaat

SEQ ID NO: 252682 - DNA, 27 bp, Artificial sequence
  SiRNA target sequence
acaataatatttttacttttgggaatt

SEQ ID NO: 252683 - DNA, 27 bp, Artificial sequence
  SiRNA target sequence
caataatatttttacttttgggaattt

SEQ ID NO: 252684 - DNA, 27 bp, Artificial sequence
  SiRNA target sequence
aataatatttttacttttgggaatttt

SEQ ID NO: 252685 - DNA, 27 bp, Artificial sequence
  SiRNA target sequence
ataatatttttacttttgggaattttt

SEQ ID NO: 252686 - DNA, 27 bp, Artificial sequence
  SiRNA target sequence
taatatttttacttttgggaatttttt

SEQ ID NO: 252687 - DNA, 27 bp, Artificial sequence
  SiRNA target sequence
aatatttttacttttgggaattttttt

SEQ ID NO: 252688 - DNA, 27 bp, Artificial sequence
  SiRNA target sequence
atatttttacttttgggaatttttttg

SEQ ID NO: 252689 - DNA, 27 bp, Artificial sequence
  SiRNA target sequence
tatttttacttttgggaatttttttgt

SEQ ID NO: 252690 - DNA, 27 bp, Artificial sequence
  SiRNA target sequence
atttttacttttgggaatttttttgtc

SEQ ID NO: 252691 - DNA, 27 bp, Artificial sequence
  SiRNA target sequence
tttttacttttgggaatttttttgtct

SEQ ID NO: 252692 - DNA, 27 bp, Artificial sequence
  SiRNA target sequence
ttttacttttgggaatttttttgtctt

SEQ ID NO: 252693 - DNA, 27 bp, Artificial sequence
  SiRNA target sequence
tttacttttgggaatttttttgtctta

SEQ ID NO: 252694 - DNA, 27 bp, Artificial sequence
  SiRNA target sequence
ttacttttgggaatttttttgtcttag

SEQ ID NO: 252695 - DNA, 27 bp, Artificial sequence
  SiRNA target sequence
tacttttgggaatttttttgtcttagt

SEQ ID NO: 252696 - DNA, 27 bp, Artificial sequence
  SiRNA target sequence
acttttgggaatttttttgtcttagtc

SEQ ID NO: 252697 - DNA, 27 bp, Artificial sequence
  SiRNA target sequence
cttttgggaatttttttgtcttagtca

SEQ ID NO: 252698 - DNA, 27 bp, Artificial sequence
  SiRNA target sequence
ttttgggaatttttttgtcttagtcat
